(12) United States Patent
Cheikh et al.

(10) Patent No.: US 7,598,361 B2
(45) Date of Patent: Oct. 6, 2009

(54) NUCLEIC ACID MOLECULES AND OTHER MOLECULES ASSOCIATED WITH THE SUCROSE PATHWAY

(75) Inventors: Nordine Cheikh, Manchester, MO (US); Dane K. Fisher, O'Fallon, MO (US); Jingdong Liu, Ballwin, MO (US)

(73) Assignee: Monsanto Technology LLC, St. Louis, MO (US)

( * ) Notice: Subject to any disclaimer, the term of this patent is extended or adjusted under 35 U.S.C. 154(b) by 747 days.

(21) Appl. No.: 09/237,183

(22) Filed: Jan. 26, 1999

(65) Prior Publication Data

US 2003/0135870 A1 Jul. 17, 2003

Related U.S. Application Data

(63) Continuation-in-part of application No. 09/229,413, filed on Jan. 12, 1999, now abandoned, and a continuation-in-part of application No. 09/210,297, filed on Dec. 8, 1998, now abandoned, and a continuation-in-part of application No. 09/199,129, filed on Nov. 24, 1998, now abandoned.

(60) Provisional application No. 60/113,224, filed on Dec. 22, 1998, provisional application No. 60/111,981, filed on Dec. 11, 1998, provisional application No. 60/109,018, filed on Nov. 19, 1998, provisional application No. 60/108,996, filed on Nov. 18, 1998, provisional application No. 60/104,123, filed on Oct. 13, 1998, provisional application No. 60/104,124, filed on Oct. 13, 1998, provisional application No. 60/104,127, filed on Oct. 13, 1998, provisional application No. 60/104,128, filed on Oct. 13, 1998, provisional application No. 60/104,126, filed on Oct. 13, 1998, provisional application No. 60/101,707, filed on Sep. 25, 1998, provisional application No. 60/101,343, filed on Sep. 22, 1998, provisional application No. 60/101,347, filed on Sep. 22, 1998, provisional application No. 60/101,344, filed on Sep. 22, 1998, provisional application No. 60/101,508, filed on Sep. 22, 1998, provisional application No. 60/101,130, filed on Sep. 21, 1998, provisional application No. 60/101,132, filed on Sep. 21, 1998, provisional application No. 60/101,131, filed on Sep. 21, 1998, provisional application No. 60/100,672, filed on Sep. 16, 1998, provisional application No. 60/100,673, filed on Sep. 16, 1998, provisional application No. 60/100,674, filed on Sep. 16, 1998, provisional application No. 60/099,697, filed on Sep. 9, 1998, provisional application No. 60/099,670, filed on Sep. 9, 1998, provisional application No. 60/099,667, filed on Sep. 9, 1998, provisional application No. 60/092,036, filed on Jul. 8, 1998, provisional application No. 60/091,405, filed on Jun. 30, 1998, provisional application No. 60/091,035, filed on Jun. 29, 1998, provisional application No. 60/090,928, filed on Jun. 26, 1998, provisional application No. 60/090,170, filed on Jun. 22, 1998, provisional application No. 60/089,793, filed on Jun. 18, 1998, provisional application No. 60/089,814, filed on Jun. 18, 1998, provisional application No. 60/089,810, filed on Jun. 18, 1998, provisional application No. 60/089,524, filed on Jun. 16, 1998, provisional application No. 60/087,422, filed on Jun. 1, 1998, provisional application No. 60/086,188, filed on May 21, 1998, provisional application No. 60/086,183, filed on May 21, 1998, provisional application No. 60/086,184, filed on May 21, 1998, provisional application No. 60/086,185, filed on May 21, 1998, provisional application No. 60/086,187, filed on May 21, 1998, provisional application No. 60/086,186, filed on May 21, 1998, provisional application No. 60/085,222, filed on May 13, 1998, provisional application No. 60/085,223, filed on May 13, 1998, provisional application No. 60/085,224, filed on May 13, 1998, provisional application No. 60/083,390, filed on Apr. 29, 1998, provisional application No. 60/083,389, filed on Apr. 29, 1998, provisional application No. 60/083,388, filed on Apr. 29, 1998, provisional application No. 60/083,387, filed on Apr. 29, 1998, provisional application No. 60/083,386, filed on Apr. 29, 1998, provisional application No. 60/083,067, filed on Apr. 27, 1998, provisional application No. 60/080,844, filed on Apr. 7, 1998, provisional application No. 60/078,368, filed on Mar. 18, 1998, provisional application No. 60/077,230, filed on Mar. 9, 1998, provisional application No. 60/077,229, filed on Mar. 9, 1998, provisional application No. 60/077,231, filed on Mar. 9, 1998, provisional application No. 60/076,912, filed on Mar. 6, 1998, provisional application No. 60/075,463, filed on Feb. 19, 1998, provisional application No. 60/075,460, filed on Feb. 19, 1998, provisional application No. 60/075,464, filed on Feb. 19, 1998, provisional application No. 60/075,461, filed on Feb. 19, 1998, provisional application No. 60/075,459, filed on Feb. 19, 1998, provisional application No. 60/074,789, filed on Feb. 19, 1998, provisional application No. 60/075,462, filed on Feb. 19, 1998, provisional application No. 60/074,565, filed on Feb. 12, 1998, provisional application No. 60/074,567, filed on Feb. 12, 1998, provisional application No. 60/074,566, filed on Feb. 12, 1998, provisional application No. 60/074,281, filed on Feb. 10, 1998, provisional application No. 60/074,280, filed on Feb. 10, 1998, provisional application No. 60/074,282, filed on Feb. 10, 1998, provisional application No. 60/074,201, filed on Feb. 10, 1998, provisional application No. 60/072,888, filed on Jan. 27, 1998, provisional application No. 60/069,472, filed on Dec. 9, 1997, provisional application No. 60/067,000, filed on Nov. 24, 1997.

(51) Int. Cl.
*C07H 21/00* (2006.01)
*C12Q 1/68* (2006.01)

(52) U.S. Cl. .................. 536/23.1; 536/27.1; 435/6; 435/69.1

(58) Field of Classification Search ................ 536/27.1, 536/23.1; 435/6, 69.1
See application file for complete search history.

(56) References Cited

OTHER PUBLICATIONS

Sigma Chemical Catalog 1990 [Published by the Sigma Chemical Company, P.O. Box 14508, St. Louis, Missouri 63178, USA] pp. 776-778, 1990.*
Gershold et al., BioEssay, vol. 18, No. 12, pp. 973-981, 1996.*
Walls et al., Journal of Leukoyte Biology, vol. 61, No. 5, pp. 545-550, 1997.*
Russell et al., Journal of Molecular Biology, vol. 244, pp. 332-350, 1994.*
Attwood, Science, vol. 290, No. 5491, pp. 471-473, 2000.*
Genebank Accession No. J04121 (Jul. 11, 1997).*
Genebank Accession No. AF022733 (Oct. 30, 1997).*
Genebank Accession No. U28214 (Mar. 20, 1997).*
Genebank Accession No. U64818 (May 15, 1997).*
Genebank Accession No. U72142 (Aug. 29, 1997).*
Genebank Accession No. E10417 (Sep. 29, 1997).*
Genebank Accession No. S46215 (May 8, 1993).*
Genebank Accession No. X02400 (Sep. 12, 1993).*
Genebank Accession No. M97476 (Apr. 27, 1993).*
Genebank Accession No. S42124 (May 8, 1993).*
Genebank Accession No. X85327 (Jul. 2, 1996).*
Genebank Accession No. U10282 (Jun. 13, 1994).*
Genebank Accession No. Z18924 (Dec. 4, 1992).*
Entrez, Accession No. A32505 (Jul. 2, 1996).
Entrez, Accession No. 1567456 (Jul. 2, 1996).
Boles et al., Entrez, Accession No. X90861 (Jul. 17, 1996).
Boles et al., Entrez, Accession No. 1085116 (Jul. 17, 1996).
Carlisle et al., Entrez, Accession No. M55191 J05629 (Mar. 7, 1995).
Carlisle et al., Entrez, Accession No. 169540 (Mar. 7, 1995).
Chipra, Entrez, Accession No. 16284 (Apr. 7, 1993).
Chipra, Entrez, Accession No. X53058 (Apr. 7, 1993).
De Graaff et al., Entrez, Accession No. Z79690 (Mar. 1, 1997).
De Graaff, Entrez, Accession No. 1865665 (Mar. 1, 1997).
Doehlert et al., "Enzymes of Sucrose and Hexose Metabolism in Developing Kernels of Two Inbreds of Maize," *Plant Physiol.* 86:1013-1019 (1988).
Echeverria et al., "Involvement of Sucrose Synthase in Sucrose Catabolism," *Phytochemistry*, 23(10):2173-2178 (1984).
Echeverria et al., "Physical and Kinetic Evidence for an Association Between Sucrose-Phosphate Synthase and Sucrose-Phosphate Phosphatase," *Plant Physiol.* 115:223-227 (1997).
Edwards et al., "Metabolism of UDP-Glucose by Developing Embryos of Round and Wrinkled Varieties of *Pisum Sativum*," *Phytochemistry*, 25(9):2033-2039 (1986).
Federspiel et al., Entrez, Accession No. AC002396 (Feb. 4, 1998).
Federspiel et al., Entrez, Accession No. 2829890 (Feb. 4, 1998).
Fink et al., "The Electronic Gene Register," *Plant Physiol.*, 108:1341-1343 (1994).
Fink et al., Entrez, Accession No. X84230 (Aug. 15, 1997).
Fink et al., Entrez, Accession No. 1174336 (Aug. 15, 1997).
Hers et al., "Fructose 2,6-Bisphosphate 2 Years After its Discovery," *Biochem. J.*, 206:1-12 (1982).
Huang et al., Entrez, Accession No. L32898 (Dec. 1, 1995).
Huang et al., Entrez, Accession No. 1100217 (Dec. 1, 1995).
Huber, "Biochemical Mechanism for Regulation of Sucrose Accumulation in Leaves during Photosynthesis," *Plant Physiol*, 91:656-662 (1989).
Huber et al., "Role of Sucrose-Phosphate Synthase in Sucrose Metabolism in Leaves," *Plant Physiol.*, 99:1275-1278 (1992).
Jang et al., Entrez, Accession No. U28215 (Mar. 21, 1997).
Jang et al., Entrez, Accession No. 1899025 (Mar. 20, 1997).
Karuppiah et al., "Purification and Characterization of Soluble (Cytosolic) and Bound (Cell Wall) Isoforms of Invertases in Barley (*Hordeum vulgare*) Elongating Stem Tissue," *Plant Physiol.* 91:993-998 (1989).
Katsube et al., Entrez, Accession No. D00667 (Jan. 17, 1992).
Katsube et al., Entrez, Accession No. 218001 (Jan. 17, 1992).
Kim et al., Entrez, Accession No. AF050129 (Jan. 2, 1999).
Kim et al., Entrez, Accession No. 4105721 (Jul. 10, 1998).
Lunn et al., "Apparent Equilibrium Constant and Mass-Action Ratio for Sucrose-Phosphate Synthase in Seeds of *Pisum Sativum*," *Biochem. J.*, 267:739-743 (1990).
Manjunath et al., "Molecular and Biochemical Characterization of Cytosolic Phosphoglucomutase in Maize," *Plant Physiol.*, 117:997-1006 (1998).
Manjunath et al., Entrez, Accession No. U89342 (Aug. 6, 1998).
Manjunath et al., Entrez, Accession No. 3294469 (Aug. 6, 1998).
Markham et al., Entrez, Accession No. AF041848 (Jun. 2, 1998).
Markham et al., Entrez, Accession No. 3170230 (Jan. 9, 1998).
Mertens et al., Entrez, Accession No. AF044973 (Apr. 2, 1998).
Mertens et al., Entrez, Accession No. 3005083 (Apr. 1, 1998).
Moore et al., Entrez, Accession No. AF037440 (Dec. 24, 1997).
Moore et al., Entrez, Accession No. 2708662 (Dec. 15, 1997).
Rea et al., "Vacuolar $H^+$-Translocating Pyrophosphatases: A New Category of Ion Translocase," *TIBS*, pp. 348-353 (1992).
Robertson et al., "Regulation of the enzymes of UDP-Sugar Metabolism During Differentiation of French Bean," *Phytochemistry*, 39(1):21-28 (1995).
Rodriguez-Suarez et al., Entrez, Accession No. 289367 (Dec. 11, 1997).
Rodriguez-Suarez et al., Entrez, Accession No. L15303 (Dec. 11, 1997).
Salvucci et al., Entrez, Accession No. L04803 (Jul. 27, 1994).
Salvucci et al., Entrez, Accession No. 170147 (Jul. 27, 1994).
Sarafian et al., Entrez, Accession No. M81892 (Mar. 23, 1992).
Sarafian et al., Entrez, Accession No. 166634 (Mar. 23, 1992).
Sato et al., "characterization and Sequence Analysis of the *scrA* Gene Encoding Enzyme $II^{Scr}$ of the *Streptococcus mutans* Phosphoenolpyruvate-Dependent Sucrose Phosphotransferase System," *Journal of Bacteriology*, 171(1):263-271 (Jan. 1989).
Sato et al., Entrez, Accession No. D13175 (Nov. 8, 1994).
Sato et al., Entrez, Accession No. 565285 (Nov. 8, 1994).
Sicher et al., "Possible Control of Maize Leaf Sucrose-Phosphate Synthase Activity by Light Modulation," *Plant Physiol.*, 79:695-698 (1985).
Stitt, "Fructose-2,6-Bisphosphate as a Regulatory Molecule in Plants," *Annu. Rev. Plant. Physiol. Plant Mol. Biol.*, 41:153-185 (1990).
Stitt et al., "Coarse Control of Sucrose-Phosphate Synthase in Leaves: Alterations of the Kinetic Properties in Response to the Rate of Photosynthesis and the Accumulation of Sucrose," *Planta*, 174:217-230 (1988).
Turner et al., "Hexokinase II of Pea Seeds," *Plant Physiol.*, 68:1123-1127 (1981).
Worrell et al., "Expression of a Maize Sucrose Phsophate Synthase in Tomato Alters Leaf Carbohydrate Partitioning," *The Plant Cell*, 3:1121-1130 (Oct. 1991).
Xu et al., "the *Ivr 1* Gene for Invertase in Maize," *Plant Physiol.*, 108:1293-1294 (1995).
Xu et al., Entrez, Accession No. U16123 (Dec. 16, 1995).
Xu et al., Entrez, Accession No. 1122439 (Dec. 14, 1995).
Xu et al., Entrez, Accession No. 169821 (May 31, 1994).
Xu et al., Entrez, Accession No. M87064 (May 31, 1994).
Yano et al., Entrez, Accession No. D16292 (Jan. 5, 1994).
Yano et al., Entrez, Accession No. 303849 (Jan. 5, 1994).
Zimmermann et al., "Purification and Properties of Spinach Leaf Cytoplasmic Fructose-1,6-Bisphosphatase," *The Journal of Biological Chemicstry*, 253(17):5952-5956 (Sep. 10, 1978).
Black et al., "Regulation and Roles for Alternative Pathways of Hexose Metabolism in Plants," *Physiol. Plantarum*, 69:387-394 (1987).
Carlisle et al., "Pyrophosphate-Dependent Phosphofructokinase," *J. Biol. Chem.*, 265:18366-18371 (1990).
Chopra et al., "Cloning and Sequencing of the *Arabidopsis* Aldolase Gene," *Plant Mol. Biol.*, 15:517-520 (1990).
Dennis and Greyson, "Fructose 6-Phosphate Metabolism in Plants," *Physiol. Plantarum*, 69:395-404 (1987).
Fahrendorf and Beck, "Cytosolic and Cell-Wall-Bound Acid Invertases from Leaves of *Urtica dioica* L.: A Comparison," *Planta*, 180:237-244 (1990).

Huber and Akazawa, "A Novel Sucrose Synthase Pathway for Sucrose Degradation in Cultured Sycamore Cells," *Plant Physiol.*, 81:1008-1013 (1986).

Jang et al., "Hexokinase as a Sugar Sensor in Higher Plants," *Plant Cell*, 9:5-19 (1997).

Katsube et al., "UDP-Glucose Pyrophosphorylase from Potato Tuber: cDNA Cloning and Sequencing," *J. Biochem.*, 108:321-326 (1990).

Kirkland and Turner, "Nucleoside Diphosphokinase of Pea Seeds," *Biochem. J.*, 72:716-720 (1959).

Mertens et al., "The Pyrophosphate-Dependent Phosphofructokinase of the Protist, *Trichomonas vaginalis*, and the Evolutionary Relationships of Protist Phosphofructokinases," *J. Mol. Evol.*, 47:739-750 (1998).

Rodriguez-Suarez and Wolosiuk, "High Level Expression in *Escherichia coli*, Purification and Properties of Chloroplast Fructose-1,6-Bisphosphatase from Rapeseed (*Brassica napus*) Leaves," *Photosyn. Res.*, 46:313-322 (1995).

Salvucci and Klein, "Identification of the Uridine-Binding Domain of Sucrose-Phosphate Synthase," *Plant Physiol.*, 102:529-536 (1993).

Sarafian et al., "Molecular Cloning and Sequence of cDNA Encoding the Pyrophosphate-Energized Vacuolar Membrane Proton Pump of *Arabidopsis thaliana*," *Proc. Natl. Acad. Sci. USA*, 89:1775-1779 (1992).

Vincente and Errington, "Structure, Function and Controls in Microbial Division," *Mol. Microbiol.*, 20:1-7 (1996).

Xu and Hall, "Cytosolic Triosephosphate Isomerase is a Single Gene in Rice," *Plant Physiol.*, 101:683-687 (1993).

Yano et al., "Molecular Cloning and Nucleotide Sequence cDNA Encoding Nucleoside Diphosphate Kinase of Rice (*Oryza sativa* L.)," *Plant Mol. Biol.*, 23:1087-1090 (1993).

Adams et al., "Complementary DNA Sequencing: Expressed Sequence Tags and Human Genome Project," *Science*, 252:1651-1656 (Jun. 21, 1991).

Ebert et al., "Identification of an Essential Upstream Element in the Nopaline Synthase Promoter by Stable and Transient Assays," *Proc. Natl. Acad. Sci.*, 84:5745-5749 (Aug. 1987).

Efstratiadis et al., "Enzymatic In Vitro Synthesis of Globin Genes," *Cell*, 7:279-288 (Feb. 1976).

Ko, "An 'Equalized cDNA Library' by the Reassociation of Short Double-Stranded cDNAs," *Nucleic Acids Research*, 18:5705-5711 (Oct. 11, 1990).

Kurata et al., "A 300 Kilobase Interval Genetic Map of Rice Including 883 Expressed Sequences," *Nature Genetics*, 8:362-372 (Dec. 1994).

McCombie et al., "*Caenorhabditis elegans* Expressed Sequence Tags Identify Gene Families and Potential Disease Gene Homologues," *Nature Genetics*, 1:124-131 (May 1992).

Okubo et al., "Large Scale cDNA Sequencing for Analysis of Quantitative and Qualitative Aspects of Gene Expression," *Nature Genetics*, 2:173-179 (Nov. 1992).

Yomo et al., "Histochemical Studies on Protease Formation in the Cotyledons of Germinating Bean Seeds," *Planta*, 112:35-43 (1973).

Venter, et al., The Sequence of the Human Genome, *Science*, 291: 1304-1351 (2001).

Woese, et al., Conservation of Primary Structure in 16S rRNA, *Nature*, 254: 83-86 (1975).

Marolda et al., "The GalF protein of *Escherichia coli* is not a UDP-glucose pyrophosphorylase but interacts with the GalU protein possibly to regulate cellular levels of UDP-glucose", *Mol. Microbiol.*, 22(5):827-840 (1996) (Abstract only).

Otero, "Copurification of vimentin, energy metabolism enzymes, and a MER5 homolog with nucleoside diphosphate kinase. Identification of tissue-specific interactions.", *J. Biol. Chem.*, 272(23):14690-14694 (1997) (Abstract only).

* cited by examiner

*Primary Examiner*—Lori A Clow
(74) *Attorney, Agent, or Firm*—Matthew L. Madsen; Ying-Horng Liu; Arnold & Porter LLP

(57) ABSTRACT

The present invention is in the field of plant biochemistry. More specifically the invention relates to nucleic acid sequences from plant cells, in particular, nucleic acid sequences from maize and soybean plants associated with the sucrose pathway. The invention encompasses nucleic acid molecules that encode proteins and fragments of proteins. In addition, the invention also encompasses proteins and fragments of proteins so encoded and antibodies capable of binding these proteins or fragments. The invention also relates to methods of using the nucleic acid molecules, proteins and fragments of proteins and antibodies, for example for genome mapping, gene identification and analysis, plant breeding, preparation of constructs for use in plant gene expression and transgenic plants.

25 Claims, No Drawings

NUCLEIC ACID MOLECULES AND OTHER MOLECULES ASSOCIATED WITH THE SUCROSE PATHWAY

CROSS REFERENCE TO RELATED APPLICATIONS

This application claims benefit under 35 U.S.C. § 119(e) of U.S. Provisional Application Nos.: 60/067,000 filed Nov. 24, 1997; 60/069,472 filed Dec. 9, 1997; 60/072,888 filed Jan. 27, 1998; 60/074,201 filed Feb. 10, 1998; 60/074,282 filed Feb. 10, 1998; 60/074,280 filed Feb. 10, 1998; 60/074,281 filed Feb. 10, 1998; 60/074,566 filed Feb. 12, 1998; 60/074,567 filed Feb. 12, 1998; 60/074,565 filed Feb. 12, 1998; 60/075,462 filed Feb. 19, 1998; 60/074,789 filed Feb. 19, 1998; 60/075,459 Feb. 19, 1998; 60/075,461 filed Feb. 19, 1998; 60/075,464 filed Feb. 19, 1998; 60/075,460 filed Feb. 19, 1998; 60/075,463 Feb. 19, 1998; 60/076,912 filed Mar. 6, 1998; 60/077,231 filed Mar. 9, 1998; 60/077,229 filed Mar. 9, 1998; 60/077,230 filed Mar. 9, 1998; 60/078,368 filed Mar. 18, 1998; 60/080,844 filed Apr. 7, 1998; 60/083,067 filed Apr. 27, 1998; 60/083,386 filed Apr. 29, 1998; 60/083,387 Apr. 29, 1998; 60/083,388 filed Apr. 29, 1998; 60/083,389 filed Apr. 29, 1998; 60/083,390 filed Apr. 29, 1998; 60/085,224 filed May 13, 1998; 60/085,223 filed May 13, 1998; 60/085,222 filed May 13, 1998; 60/086,186 filed May 21, 1998; 60/086,187 filed May 21, 1998; 60/086,185 filed May 21, 1998; 60/086,184 filed May 21, 1998; 60/086,183 filed May 21, 1998; 60/086,188 filed May 21, 1998; 60/087,422 filed Jun. 1, 1998; 60/089,524 filed Jun. 16, 1998; 60/089,810 filed Jun. 18, 1998; 60/089,814 Jun. 18; 1998; 60/089,793 filed Jun. 18, 1998; 60/090,170 filed Jun. 22, 1998; 60/090,928 Jun. 26, 1998; 60/091,035 filed Jun. 29, 1998; 60/091,405 filed Jun. 30, 1998; 60/092,036 filed Jul. 8, 1998; 60/099,667 filed Sep. 9, 1998; 60/099,670 filed Sep. 9, 1998; 60/099,697 filed Sep. 9, 1998; 60/100,674 filed Sep. 16, 1998; 60/100,673 filed Sep. 16, 1998; 60/100,672 filed Sep. 16, 1998; 60/101,131 filed Sep. 21, 1998; 60/101,132 Sep. 21, 1998; 60/101,130 filed Sep. 21, 1998; 60/101,508 filed Sep. 22, 1998; 60/101,344 filed Sep. 22, 1998; 60/101,347 filed Sep. 22, 1998; 60/101,343 filed Sep. 22, 1998; 60/101,707 filed Sep. 25, 1998; 60/104,126 filed Oct. 13, 1998; 60/104,128 filed Oct. 13, 1998; 60/104,127 filed Oct. 13, 1998; 60/104,124 filed Oct. 13, 1998; 60/104,123 filed Oct. 13, 1998; 60/109,018 filed Nov. 19, 1998; 60/108,996 filed Nov. 18, 1998; 60/111,981 filed Dec. 11, 1998; and 60/113,224 filed Dec. 22, 1998; and claims the benefit under 35 U.S.C. § 120 as a continuation-in-part application of U.S. application Ser. No. 09/199,129 filed Nov. 24, 1998 now abandoned; Ser. No. 09/210,297 filed Dec. 8, 1998 now abandoned; and Ser. No. 09/229,413 filed Jan. 12, 1999 now abandoned, the disclosures of which applications are herein incorporated by reference in their entirety.

FIELD OF THE INVENTION

The present invention is in the field of plant biochemistry. More specifically the invention relates to nucleic acid sequences from plant cells, in particular, nucleic acid sequences from maize and soybean plants associated with the sucrose pathway. The invention encompasses nucleic acid molecules that encode proteins and fragments of proteins. In addition, the invention also encompasses proteins and fragments of proteins so encoded and antibodies capable of binding these proteins or fragments. The invention also relates to methods of using the nucleic acid molecules, proteins and fragments of proteins and antibodies, for example for genome mapping, gene identification and analysis, plant breeding, preparation of constructs for use in plant gene expression and transgenic plants.

BACKGROUND OF THE INVENTION

Carbon fixed during photosynthesis is either retained in the chloroplast and converted to a storage carbohydrate, for example, starch, or it is transferred to the cytosol in the form of triose phosphates and converted to sucrose. The newly synthesized sucrose in source tissues is a major transported form of reduced carbon in higher plants and can be either metabolized into other carbohydrates, stored in the vacuole or exported to other plant tissues. Plant tissues where sucrose is synthesized, such as leaves, are often referred to as 'source' tissues. Translocated sucrose is retained in 'sink' tissues (such as expanding leaves, growing seeds, flowers, roots or tubers, and fruit) and may be assimilated, or further metabolized to sustain cell maintenance or fuel growth, or be converted to alternative storage compounds (e.g., starch, fats). The relative type and size of these carbohydrate pools vary during tissue development, between different plant species, and within the same species subject to different environmental conditions. Such differences are reported to affect the yield and quality of agricultural produce.

Sucrose synthesis and catabolism are reported to be highly coordinated and regulated processes that may also be coordinately regulated with other dedicated metabolic pathways in a particular plant, plant organ or cell type. Sucrose synthesis is reported to be coordinately regulated with starch metabolism and photosynthesis in green 'source' plant tissues. Sucrose supply by transport mechanisms to actively growing 'sink' tissues is reported to be coordinated with plant development. In growing sink tissues, the supply of carbohydrate is reported to be important to other metabolic pathways and physiological processes including respiration, starch biosynthesis, cell wall biogenesis, lipid and protein biosynthesis. Sucrose synthesis and/or transport is also reported to play a role in the carbohydrate capacity that is available to growing fruits and seeds. Sucrose resynthesis during seed germination is reported to play a role in seedling vigor and agronomic stand establishment in many plant species during early plant development.

In many plant species, enzymes of pathways involved in sucrose metabolism can play a role in plant physiology and plant growth and development. Compartmentation and temporal regulation of genes and enzymes of sucrose metabolic pathways can allow multiple pathways to utilize sucrose as a common metabolite. Flux through a particular sucrose metabolic pathway can define the utilization of sucrose in any tissue or developmental stage. Sucrose and its metabolite products have been reported to play a role in gene regulation and expression of the sucrose pathway and other metabolic pathways in plants.

Reviews on sucrose metabolism in plants include Avigad, In: *Encyclopedia of Plant Physiology*, Vol 13A, Loewus and Tanner, eds., Springer Verlag, Heidelberg, 217-347 (1982); Hawker, In: *Biochemistry of Storage Carbohydrates in Green Plants*, Dey and Dixon, eds., Academic Press, London, 1-51 (1985); Huber et al., In: *Carbon Partitioning Within and Between Organisms*, Pollock et al., eds., Bios Scientific, Oxford, 1-26 (1992); Stitt et al., In: *Biochemistry of Plants*, Vol 10, Hatch and Boardman, eds., Academic Press, New York, 327-407 (1987); Quick and Schaffer, In: *Photoassimilate Distribution In: Plants And Crops*, Zamski and Schaffer, eds., Marcel Dekker Inc., New York, 115-156 (1996), all of which are herein incorporated by reference in their entirety.

The synthesis of sucrose precursors (triose and hexose phosphates) is derived from either photosynthetic $CO_2$ fixation or degradation of previously deposited storage reserves. One substrate for sucrose synthesis in photosynthetic tissues is three carbon sugar phosphates. These are exported from the chloroplast during photosynthesis, predominantly in the form of triose phosphates. The pool of triose phosphates, dihydroxyacetone phosphate ("DHAP"), and glyceraldehyde-3-phosphate ("GAP"), is maintained at equilibrium within the cytoplasm by triose phosphate isomerase (EC 5.3.1.1). A subsequent reaction involves an aldol condensation of DHAP and GAP, catalyzed by the enzyme fructose 1,6-bisphosphate aldolase (often called aldolase) (EC 4.1.2.13) to form fructose 1,6-bisphosphate ("F1,6BP"). Fructose-1,6-bisphosphatase ("FBPase") (EC 3.1.3.11) catalyzes the cleavage of phosphate from the C1 carbon of fructose-1,6-bisphosphate to form fructose-6-phosphate ("F6P"). This reaction is essentially irreversible and has been reported to represent the first committed step within the pathway of sucrose synthesis. The cytosolic FBPase has been reported to be subject to allosteric regulation and may serve to coordinate the rate of sucrose synthesis with that of photosynthesis. Fructose 2,6-bisphosphate ("F2,6BP") is reported to be a regulator of FBPase (Black et al., In: *Regulation of Carbohydrate Partitioning In Photosynthetic Tissue*, Heath and Preiss, eds., Waverly, Baltimore, 109-126 (1985); Stitt et al., In: *Biochemistry Of Plants*, Vol. 10, Hatch and Boardman, eds., Academic Press, New York, 327-407 (1987), both of which are herein incorporated by reference in their entirety). The concentration of F2,6BP is reported to be controlled in plants by two enzymes, fructose-2,6-bisphosphatase (F2,6Bpase) (EC 3.1.3.46) and fructose-6-phosphate,2-kinase (F6P,2K) (EC 2.7.1.105) (Stitt, *Annu. Rev. Plant Physiol. Plant Mol. Biol.* 41: 153-181 (1990), the entirety of which is herein incorporated by reference).

Glucose-6-phosphate ("G6P") and glucose-1-phosphate ("G1P") are reported to be maintained in equilibrium with the F6P pool by the action of phosphoglucoisomerase ("PGI") (EC 5.3.1.9) and phosphoglucomutase ("PGM") (EC 5.4.2.2), respectively. Uridine diphosphate glucose ("UDPG") and pyrophosphate ("PPi") are formed from uridine triphosphate ("UTP") and G1P catalyzed by the enzyme UDPG-pyrophosphorylase ("UDPGase") (EC 2.7.7.9). This reaction is reversible and net flux in the direction of sucrose synthesis is reported to require removal of its products, particularly PPi. A pyrophosphate-dependent proton pump, vacuolar $H^+$-translocating-pyrophosphatase (EC 3.6.1.1), has been identified within the vacuolar membrane and has been reported to utilize pyrophosphate to sustain a proton gradient formed between these two compartments (Rea et al., *Trends in Biol. Sci.* 17: 348-353 (1992), the entirety of which is herein incorporated by reference).

A pyrophosphate-dependent fructose-6-phosphate phosphotransferase ("PFP") (EC 2.7.1.90) is also present in the cytoplasm and catalyzes the reversible production of F1,6BP and Pi from F6P and PPi. One reported function of PFP is to operate in a futile cycle with the cytosolic FBPase, and function as a "pseudopyrophosphatase" recycling PPi. Uridine diphosphate glucose is then combined with F6P to form sucrose-6-phosphate ("S6P"). This reaction is catalyzed by sucrose phosphate synthase ("SPS") (EC 2.4.1.14). Attachment of UDP to the glucose moiety activates the C1 carbon atom of UDPG, which is necessary for the subsequent formation of a glycosidic bond in sucrose. In certain organisms, SPS is capable of using adenine diphosphate glucose ("ADPG"), instead of UDPG, as a substrate. The use of nucleotide biphosphate sugars is a feature of metabolic pathways leading to the production of disaccharides and polysaccharides. SPS is reported to be subject to allosteric and covalent regulation and, in conjunction with the cytosolic FBPase, reportedly serves to coordinate the rate of sucrose synthesis with the rate of photosynthesis. The reported final reaction in the pathway is catalyzed by sucrose-6-phosphate phosphatase ("SPPase" or "SPP") (EC 3.1.3.24), which catalyzes the hydrolysis of S6P to sucrose. It has been reported that SPS and SPPase may associate to form a multienzyme complex, that the rate of sucrose-6-phosphate synthesis by SPS is enhanced in the presence of SPP, and that the rate of sucrose-6-phosphate hydrolysis by SPP is increased in the presence of SPS (Echeverria et al., *Plant Physiol.* 115: 223-227 (1997), herein incorporated by reference in its entirety).

I. Sucrose Synthesis

Reviews describing fructose-1,6-bisphosphatase ("FBPase", EC 3.1.3.11) include those by Hers and Van Shaftingen, *Biochem J.* 206:1-12 (1982), the entirety of which is herein incorporated by reference, and Stitt, *Annu. Rev. Plant Physiol. Plant Mol. Biol.* 41:153-181 (1990). Two isoforms of FBPase are reported to exist in plants. The first isoform is associated with the plastid and occurs largely in photosynthetic plastids. The second isoform, located in the cytoplasm, is reported to be involved in both gluconeogenesis and sucrose synthesis (Zimmerman et al., *J. Biol. Chem.* 253: 5952-5956 (1978); Stitt and Heldt, *Planta* 164: 179-188 (1985), both of which are hereby incorporated by reference in their entirety). FBPase catalyzes an irreversible reaction in the direction of F6P synthesis in vivo and has been reported to represent the first committed step in the pathway of sucrose synthesis. The properties of the enzyme are reported to involve the action of several regulatory metabolites (Stitt et al., In: *Biochemistry Of Plants*, Vol. 10, Hatch and Boardman, eds., Academic Press, New York, 327-407 (1987)). The enzyme reportedly has a high affinity for its substrate F1,6BP, a requirement for $Mg^{2+}$, a requirement for a neutral pH, is weakly inhibited (Km 2-4 μm) by adenosine monophosphate (AMP), and is strongly inhibited by the regulatory metabolite F2,6BP (Hers and Van Shaftingen, *Biochem J.* 206: 1-12 (1982); Black et al., In: *Regulation of Carbohydrate Partitioning In Photosynthetic Tissue*, Heath and Preiss, eds., Waverly, Baltimore, 109-126 (1985); Huber, *Annu. Rev. Plant Physiol.* 37: 233-246 (1986); Stitt et al., In: *Biochemistry Of Plants*, Vol. 10, Hatch and Boardman, eds., Academic Press, New York, 327-407 (1987), all of which are herein incorporated by reference in their entirety). F2,6BP is also an activator of PFP and reportedly plays a role in the regulation of gluconeogenetic and respiratory metabolism.

The concentration of F2,6BP is reportedly determined in plants by two enzymes, fructose-2,6-bisphosphatase ("F2,6BPase") (EC 3.1.3.46) and fructose-6-phosphate,2-kinase ("F6P,2K") (EC 2.7.1.105). A review of these enzymes is provided by Stitt, *Annu. Rev. Plant Physiol. Plant Mol. Biol.* 41: 153-181 (1990). Regulation of the activity of the F1,6FBPase and the rate of sucrose synthesis is reported to be, at least in part, brought about by changes in the concentration of F2,6BP.

Sucrose phosphate synthase (SPS (EC 2.4.1.14)) catalyzes a reaction that is displaced from equilibrium in vivo in the direction of S6P synthesis and is reported as an essentially irreversible reaction in vivo (Stitt et al., In: *Biochemistry Of Plants*, Vol. 10, Hatch and Boardman, eds., Academic Press, New York, 327-407 (1987); Lunn and Rees, *Biochem. J.* 267: 739-743 (1990), the entirety of which is herein incorporated by reference; U.S. Pat. No. 5,665,892, the entirety of which is herein incorporated by reference). SPS has been purified from spinach and *Zea mays*, and the amino acid and cDNA sequences have been published (Worrel et al., *Plant Cell* 3:1121-1130 (1991); Klein et al., *Planta* 190: 498-510 (1993); Sonnewald et al., *Planta* 189: 174-181 (1993), all of which are herein incorporated by reference in their entirety). The enzyme has a subunit molecular weight of 117 kDa from spinach (Klein et al., *Planta* 190: 498-510 (1993); Sonnewald et al., *Planta* 189: 174-181 (1993), both of which are herein incorporated by reference) and pea (Lunn and Rees, *Phytochem.* 29: 1057-1063 (1990), the entirety of which is herein incorporated by reference) and 135 kDa from *Zea mays* (Worrel et al., *Plant Cell* 3:1121-1130 (1991)). The native enzyme reportedly exists as a tetramer (Walker and Huber, *Plant Physiol.* 89: 518-524 (1988); Lunn and Rees, *Phytochem.* 29: 1057-1063 (1990); Worrel et al., *Plant Cell* 3:1121-1130 (1991), although dimeric molecular weights have been reported (Klein et al., *Planta* 190: 498-510 (1993), the entirety of which is herein incorporated by reference). Activity has been observed for SPS at both dimeric and tetrameric molecular weights (Sonnewald et al., *Planta* 189:174-181 (1993), the entirety of which is herein incorporated by reference).

SPS is located in the cytosol, has a neutral pH optimum, and has been detected in all plant tissues which undertake active sucrose synthesis. SPS is also reported to undertake active sucrose synthesis. An increase in abundance of the enzyme is has been reported during the development of leaves, germination of seeds and ripening of fruit. The enzyme has been reported to be subject to regulation by metabolites and is activated by G6P and is inhibited by Pi. Pi and GP6 are reported to act competitively at an allosteric site of the enzyme. In the presence of high Pi concentrations, the enzyme is phosphorylated which reduces activity of the enzyme. It has also been reported that light-induced photosynthesis increases the activity of SPS in crude extracts (Sicher and Kremer, *Plant Physiol.* 79: 910-912 (1984), Sicher and Kremer, *Plant Physiol.* 79: 695-698 (1985); Pollock and Housley, *Ann. Bot.* 55: 593-596 (1985), all of which are herein incorporated by reference in their entirety). In addition, it has been reported that compounds altering the phosphate status of the leaf can simulate the effects of light. Feeding leaves mannose, which sequesters phosphate by its conversion to the non-metabolized mannose-6-P, has been reported to cause activation of SPS (Stitt et al., *Planta* 174: 217-230 (1988), the entirety of which is herein incorporated by reference).

The phosphorylation and dephosphorylation of SPS is catalyzed by SPS-phosphatase and SPS-kinase, respectively (Huber et al., *Plant Physiol.* 99: 1275-1278 (1992). Hydrolysis of sucrose-6-P to sucrose is catalyzed by sucrose-6-phosphatase (SPPase or SPP) (EC 3.1.3.24). The activity of both SPS and SPP is reported to be affected by a multienzyme complex between SPS and SPP (Echeverria et al., *Plant Physiol.* 115: 223-227 (1997)).

Regulatory properties of SPS and FBPase are reported to coordinate the rate of sucrose synthesis with that of photosynthesis (Stitt, In: *Plant Physiology, Biochemistry and Molecular Biology*, Dennis and Turpin, eds., Singapore, London, 319-340 (1990), the entirety of which is herein incorporated by reference). When photosynthesis produces triose phosphate in excess of the rate of sucrose synthesis, a feed-forward activation of sucrose synthesis occurs. Triose phosphate crosses the chloroplast membrane in exchange for cytosolic Pi. Under these conditions, F6P,2-kinase activity is reduced and the inhibition of F2,6Bpase is decreased.

As cytosolic F2,6BP falls, F2,6BPase activity increases, and F6P levels increase. Hexose phosphate levels are reported to increase due to PGM and PGI, and with low Pi, activate SPS and F1,6BPase. Reduction in rate of photosynthesis must result in a deactivation of sucrose synthesis, which occurs through decreased cytosolic triose-P, increased Pi and ultimately increased F2,6BP concentration and reduced SPS activity (Stitt, *Phil. Trans. R Soc. Lond. B* 342: 225-233 (1993); Huber et al., *Plant Physiol.* 99: 1275-1278 (1992); Neuhaus et al., *Planta* 181: 583-592 (1990), both of which are herein incorporated by reference).

II. Metabolic Pathways of Sucrose Catabolism

Sucrose can initially be cleaved by invertases (EC 3.2.1.26) or by sucrose synthases (EC 2.4.1.13). Invertases, which are classified as acid or alkaline in pH preference (Karuppiah et al., *Plant Physiol.* 91: 993-998 (1989); Fahrendorf and Beck, *Planta* 180: 237-244 (1990); Iwatsubo et al., *Biosc. Biotech. Biochem.* 56: 1959-1962 (1992); Unger et al., *Plant Physiol.* 104: 1351-1357 (1994); Avigad, In: *Encyclopedia of Plant Physiology*, Vol 13A, Loewus and Tanner, eds., Springer Verlag, Heidelberg, 217-347 (1982), all of which are herein incorporated by reference in their entirety), irreversibly cleave sucrose into glucose and fructose, both of which is usually phosphorylated for further metabolism. The invertase pathway usually is associated with rapidly growing sink tissues such as expanding leaves, expanding internodes, flower petals, and early fruit development (Avigad, In: *Encyclopedia of Plant Physiology*, Vol 13A, Loewus and Tanner, eds., Springer Verlag, Heidelberg, 217-347 (1982); Huber, *Plant Physiol.* 91: 656-662 (1989); Morris and Arthur, *Phytochem.* 23: 2163-2167 (1984); Hawker et al., *Phytochem.* 15: 1441-1443 (1976); Schaffer et al., *Plant Physiol.* 69: 151-155 (1987), all of which are herein incorporated by reference in their entirety).

Sucrose synthase carries out the kinetically reversible transglycosylation of sucrose and UDP into fructose and UDPG, requiring only the phosphorylation of fructose for additional metabolism. Polysaccharide biosynthesis in sink tissues may utilize a sucrose synthase mediated sucrose catabolism (Avigad, In: *Encyclopedia of Plant Physiology*, Vol 13A, Loewus and Tanner, eds., Springer Verlag, Heidelberg, 217-347 (1982); Doehlert et al., *Plant Physiol.* 86: 1013-1019 (1988); Dale and Housley *Plant Physiol.* 82: 7-10 (1986), all of which are herein incorporated by reference). Respiring tissues reportedly utilize either sucrose synthase or invertase metabolic pathways (Echeverria and Humphreys, *Phytochem.* 23: 2173-2178 (1984); Uritani and Asahi, In: *The Biochemistry of Plants* Vol. 2, Davies, ed., Academic Press, New York, 463-487 (1980), all of which are herein incorporated by reference in their entirety). Tissues that are undergoing respiration, starch biosynthesis, amino acid and fatty acid synthesis, rapid expansion or growth, and other cellular metabolism, can utilize several sucrose metabolic pathways which may be temporally or compartmentally regulated (Doehlert et al., *Plant Physiol.* 86: 1013-1019 (1988); Doehlert, *Plant Physiol.* 78: 560-567 (1990); Doehlert and Choury, In: *Recent Advances in Phloem Transport and Assimilate Compartmentation*, Bonnemain et al., eds., Ouest editions, Nantes, France, 187-195 (1991); Delmer and Stone, In: *The Biochemistry of Plants*, Vol. 14, Preiss, ed., Academic Press, San Diego, 373-420 (1988); Maas et al., *EMBO J.* 9: 3447-3452 (1990), all of which are herein incorporated by reference in their entirety).

Hexose kinases are a class of enzymes responsible for the phosphorylation of hexoses, and are classified into two groups. Hexokinase (EC 2.7.1.1) can phosphorylate either glucose or fructose, with different isoforms often unique to different tissues or plant species. Different isoforms can have affinities for different hexoses (Turner and Copeland, *Plant Physiol.* 68: 1123-1127 (1981), the entirety of which is herein incorporated by reference; Copeland and Turner, In: *The Biochemistry of Plants*, Vol. 11, Stumpf and Conn, eds., Academic Press, New York, 107-128 (1987), the entirety of which is herein incorporated by reference). Hexokinases include fructokinases (EC 2.7.1.11), which typically have specific affinities for fructose (Doehlert, *Plant Physiol.* 89: 1042-1048 (1989); Renz and Stitt *Planta* 190: 166-175 (1993), both of which are herein incorporated by reference). Fructokinases can also be specific in their affinity for nucleotides. The extent to which a fructokinase utilizes UTP may play a physiological role in how efficiently UDP can be recycled for sucrose synthase activity in a particular tissue (Huber and Akazawa, *Plant Physiol.* 81: 1008-1013 (1986); Xu et al., *Plant Physiol.* 90: 635-642 (1989), both of which are herein incorporated by reference). UDP levels for the sucrose synthase reaction may be maintained, even in the case of an ATP-specific fructokinase, by the enzyme NDP-kinase (EC 2.7.4.6).

NDP-kinase has been reported in several plant tissues (Kirkland and Turner, *J. Biochem.* 72: 716-720 (1959); Bryce and Nelson, *Plant Physiol.* 63: 312-317 (1979); Dancer et al., *Plant Physiol.* 92: 637-641 (1990); Yano et al., *Plant Molec. Biol.* 23: 1087-1090 (1993), all of which are herein incorporated by reference in their entirety). Fructokinase can be substrate inhibited by fructose. In addition, sucrose synthase can be inhibited by fructose (Doehlert, *Plant Sci.* 52: 153-157 (1987); Morell and Copeland, *Plant Physiol.* 78: 140-154 (1985), Ross and Davies, *Plant Physiol.* 100: 1008-1013 (1992), all of which are herein incorporated by reference in their entirety). Whereas plant tissues where sucrose is catabolized by sucrose synthase predominantly contain fructokinases (Xu et al., *Plant Physiol.* 90: 635-642 (1989); Kursanov et al., *Soviet Plant Physiol.* 37: 507-515 (1990); Ross et al., *Plant Physiol.* 90: 748-756 (1994)), plant tissues where sucrose is catabolized by invertase often contain hexokinases (Nakamura et al., *Plant Physiol.* 81: 215-220 (1991)). Tissues which have both invertase and sucrose synthase activity may contain both hexose kinases (Nakamura et al., *Plant Physiol.* 81: 215-220 (1991), the entirety of which is herein incorporated by reference). F6P resulting from hexose kinase activity can be further metabolized in glycolysis or used in resynthesis of sucrose by SPS. G6P resulting from hexose kinase activity can enter the pentose phosphate pathway, via G6P dehydrogenase (EC 1.1.1.49), or be converted to F6P by phosphoglucoisomerase ("PGI") (EC 5.3.1.9) or G1P by phosphoglucomutase ("PGM") (EC 5.4.2.2) (Rees, In: *Encyclopedia of Plant Physiology* Vol 18, Douce and Day, eds., Springer Verlag, Berlin, 391-417 (1985); Copeland and Turner, In: *The Biochemistry of Plants* Vol. 11, Stumpf and Conn, eds., Academic Press, New York, 107-128 (1987); Foster and Smith, *Planta* 180: 237-244 (1993), all of which are herein incorporated by reference in their entirety).

PGI and PGM are reported to be ubiquitous and reversible with commitments of G6P to either F6P or G1P resulting from fluxes in metabolites further along each pathway, i.e., depending on the cell needs for glycolysis (F6P) or starch biosynthesis (G1P) (Edwards and Rees, *Phytochem.* 25: 2033-2039 (1986); Kursanov et al., *Soviet Plant Physiol.* 37: 507-515 (1990); Tobias et al., *Plant Physiol.* 99: 140-145 (1992), all of which are herein incorporated by reference in their entirety). UDPG formed by sucrose synthase may be utilized directly for cellulose or callose biosynthesis via UDP-glucose dehydrogenase (EC 1.1.1.2) (Robertson et al., *Phytochem.* 39: 21-28 (1995), the entirety of which is herein incorporated by reference), can be used for sucrose synthesis by SPS or sucrose synthase, or for glycolysis or starch metabolism dependent on further metabolism by UDP-glucose pyrophosphorylase (EC 2.7.7.9). UDP-glucose phosphorylase has been reported to be a largely reversible enzyme (Kleczkowski, *Phytochem.* 37: 1507-1515 (1994), the entirety of which is herein incorporated by reference). Flux through UDP-glucose pyrophosphorylase is reported to be influenced by metabolite levels and utilization of reaction products further along in the pathways (Doehlert et al., *Plant Physiol.* 86: 1013-1019 (1988); Huber and Akazawa, *Plant Physiol.* 81: 1008-1013 (1986); Zrenner et al., *Planta* 190: 247-252 (1993), all of which are herein incorporated by reference in their entirety). The reversibility of PGI, PGM and UDPGPPase has been reported to provide for metabolic variability and networking in metabolism, independent of which initial enzyme cleaved sucrose.

The fate of F6P reportedly plays a role in carbohydrate metabolism. NTP-phosphofructokinase (PFK) (EC 2.7.1.11) (Copeland and Turner, In: *The Biochemistry of Plants* Vol. 11, Stumpf and Conn, eds., Academic Press, New York, 107-128 (1987); Dennis and Greyson, *Plant Physiol.* 69: 395-404 (1987); Rees, In: *The Biochemistry of Plants* Vol. 14, Preiss, ed., Academic Press, San Diego, 1-33 (1988), all of which are herein incorporated by reference in their entirety) is reported to irreversibly convert F6P to F16BP and is associated with glycolysis. The reverse reaction of F16BP to F6P, associated with gluconeogenesis, is essentially irreversible, and is catalyzed by FBPase (EC 3.1.3.11) (Black et al., *Plant Physiol.* 69: 387-394 (1987). Both reactions may be carried out in a reversible manner by a PPi-dependent fructose-6-phosphate phosphotransferase or PPi-phosphofructokinase (PFP; EC 2.7.1.90) (Black et al., *Plant Physiol.* 69: 387-394 (1987).

PPi-dependent fructose-6-phosphate phosphotransferase or PPi-phosphofructokinase is reported to play a role in the generation of biosynthetic intermediates (Dennis and Greyson, *Plant Physiol.* 69: 395-404 (1987); Tobias et al., *Plant Physiol.* 99: 146-152 (1992), the entirety of which is herein incorporated by reference) in addition to the cycling of PPi for UDPGPPase and ultimately UDP for sucrose synthase (Huber and Akazawa, *Plant Physiol.* 81: 1008-1013 (1986); Black et al., *Plant Physiol.* 69: 387-394 (1987); Rees, In: *The Biochemistry of Plants* Vol. 14, Preiss, ed., Academic Press, San Diego, 1-33 (1988), all of which are herein incorporated by reference in their entirety).

II. Expressed Sequence TAG Nucleic Acid Molecules

Expressed sequence tags, or ESTs are randomly sequenced members of a cDNA library (or complementary DNA)(McCombie et al., *Nature Genetics* 1:124-130 (1992); Kurata et al., *Nature Genetics* 8:365-372 (1994); Okubo et al., *Nature Genetics* 2:173-179 (1992), all of which references are incorporated herein in their entirety). The randomly selected clones comprise insets that can represent a copy of up to the full length of a mRNA transcript.

Using conventional methodologies, cDNA libraries can be constructed from the mRNA (messenger RNA) of a given tissue or organism using poly dT primers and reverse transcriptase (Efstratiadis et al., *Cell* 7:279-3680 (1976), the entirety of which is herein incorporated by reference; Higuchi et al., *Proc. Natl. Acad. Sci.* (U.S.A.) 73:3146-3150 (1976), the entirety of which is herein incorporated by reference; Maniatis et al., *Cell* 8:163-182 (1976) the entirety of which is herein incorporated by reference; Land et al., *Nucleic Acids Res.* 9:2251-2266 (1981), the entirety of which is herein incorporated by reference; Okayama et al., *Mol. Cell. Biol.* 2:161-170 (1982), the entirety of which is herein incorporated by reference; Gubler et al., *Gene* 25:263-269 (1983), the entirety of which is herein incorporated by reference).

Several methods may be employed to obtain full-length cDNA constructs. For example, terminal transferase can be used to add homopolymeric tails of dC residues to the free 3' hydroxyl groups (Land et al., *Nucleic Acids Res.* 9:2251-2266 (1981), the entirety of which is herein incorporated by reference). This tail can then be hybridized by a poly dG oligo which can act as a primer for the synthesis of full length second strand cDNA. Okayama and Berg, *Mol. Cell. Biol.* 2:161-170 (1982), the entirety of which is herein incorporated by reference, report a method for obtaining full length cDNA constructs. This method has been simplified by using synthetic primer-adapters that have both homopolymeric tails for priming the synthesis of the first and second strands and restriction sites for cloning into plasmids (Coleclough et al., *Gene* 34:305-314 (1985), the entirety of which is herein incorporated by reference) and bacteriophage vectors (Krawinkel et al., *Nucleic Acids Res.* 14:1913 (1986), the entirety of which is herein incorporated by reference; Han et al., *Nucleic Acids Res.* 15:6304 (1987), the entirety of which is herein incorporated by reference).

These strategies have been coupled with additional strategies for isolating rare mRNA populations. For example, a typical mammalian cell contains between 10,000 and 30,000 different mRNA sequences (Davidson, *Gene Activity in Early Development,* 2nd ed., Academic Press, New York (1976), the entirety of which is herein incorporated by reference). The number of clones required to achieve a given probability that a low-abundance mRNA will be present in a cDNA library is $N=(\ln(1-P))/(\ln(1-1/n))$ where N is the number of clones required, P is the probability desired and 1/n is the fractional proportion of the total mRNA that is represented by a single rare mRNA (Sambrook et al., *Molecular Cloning: A Laboratory Manual,* 2nd ed., Cold Spring Harbor Laboratory Press (1989), the entirety of which is herein incorporated by reference).

A method to enrich preparations of mRNA for sequences of interest is to fractionate by size. One such method is to fractionate by electrophoresis through an agarose gel (Pennica et al., *Nature* 301:214-221 (1983), the entirety of which is herein incorporated by reference). Another such method employs sucrose gradient centrifugation in the presence of an agent, such as methylmercuric hydroxide, that denatures secondary structure in RNA (Schweinfest et al., *Proc. Natl. Acad. Sci.* (U.S.A.) 79:4997-5000 (1982), the entirety of which is herein incorporated by reference).

A frequently adopted method is to construct equalized or normalized cDNA libraries (Ko, *Nucleic Acids Res.* 18:5705-5711 (1990), the entirety of which is herein incorporated by reference; Patanjali et al., *Proc. Natl. Acad. Sci.* (U.S.A.) 88:1943-1947 (1991), the entirety of which is herein incorporated by reference). Typically, the cDNA population is normalized by subtractive hybridization (Schmid et al., *J. Neurochem.* 48:307-312 (1987), the entirety of which is herein incorporated by reference; Fargnoli et al., *Anal. Biochem.* 187:364-373 (1990), the entirety of which is herein incorporated by reference; Travis et al., *Proc. Natl. Acad. Sci.* (U.S.A.) 85:1696-1700 (1988), the entirety of which is herein incorporated by reference; Kato, *Eur. J. Neurosci.* 2:704-711 (1990); and Schweinfest et al., *Genet. Anal. Tech. Appl.* 7:64-70 (1990), the entirety of which is herein incorporated by reference). Subtraction represents another method for reducing the population of certain sequences in the cDNA library (Swaroop et al., *Nucleic Acids Res.* 19:1954 (1991), the entirety of which is herein incorporated by reference).

ESTs can be sequenced by a number of methods. Two basic methods may be used for DNA sequencing, the chain termination method of Sanger et al., *Proc. Natl. Acad. Sci.* (U.S.A.) 74:5463-5467 (1977), the entirety of which is herein incorporated by reference and the chemical degradation method of Maxam and Gilbert, *Proc. Nat. Acad. Sci.* (U.S.A.) 74:560-564 (1977), the entirety of which is herein incorporated by reference. Automation and advances in technology such as the replacement of radioisotopes with fluorescence-based sequencing have reduced the effort required to sequence DNA (Craxton, *Methods* 2:20-26 (1991), the entirety of which is herein incorporated by reference; Ju et al., *Proc. Natl. Acad. Sci.* (U.S.A.) 92:4347-4351 (1995), the entirety of which is herein incorporated by reference; Tabor and Richardson, *Proc. Natl. Acad. Sci.* (U.S.A.) 92:6339-6343 (1995), the entirety of which is herein incorporated by reference). Automated sequencers are available from, for example, Pharmacia Biotech, Inc., Piscataway, N.J. (Pharmacia ALF), LI-COR, Inc., Lincoln, Neb. (LI-COR 4,000) and Millipore, Bedford, Mass. (Millipore BaseStation).

In addition, advances in capillary gel electrophoresis have also reduced the effort required to sequence DNA and such advances provide a rapid high resolution approach for sequencing DNA samples (Swerdlow and Gesteland, *Nucleic Acids Res.* 18:1415-1419 (1990); Smith, *Nature* 349:812-813 (1991); Luckey et al., *Methods Enzymol.* 218:154-172 (1993); Lu et al., *J. Chromatog. A.* 680:497-501 (1994); Carson et al., *Anal. Chem.* 65:3219-3226 (1993); Huang et al., *Anal. Chem.* 64:2149-2154 (1992); Kheterpal et al., *Electrophoresis* 17:1852-1859 (1996); Quesada and Zhang, *Electrophoresis* 17:1841-1851 (1996); Baba, *Yakugaku Zasshi* 117: 265-281 (1997), all of which are herein incorporated by reference in their entirety).

ESTs longer than 150 nucleotides have been found to be useful for similarity searches and mapping (Adams et al., *Science* 252:1651-1656 (1991), herein incorporated by reference). ESTs, which can represent copies of up to the full length transcript, may be partially or completely sequenced. Between 150-450 nucleotides of sequence information is usually generated as this is the length of sequence information that is routinely and reliably produced using single run sequence data. Typically, only single run sequence data is obtained from the cDNA library (Adams et al., *Science* 252: 1651-1656 (1991). Automated single run sequencing typically results in an approximately 2-3% error or base ambiguity rate (Boguski et al., *Nature Genetics* 4:332-333 (1993), the entirety of which is herein incorporated by reference).

EST databases have been constructed or partially constructed from, for example, *C. elegans* (McCombrie et al., *Nature Genetics* 1:124-131 (1992)), human liver cell line HepG2 (Okubo et al., *Nature Genetics* 2:173-179 (1992)), human brain RNA (Adams et al., *Science* 252:1651-1656 (1991); Adams et al., *Nature* 355:632-635 (1992)), *Arabidopsis*, (Newman et al., *Plant Physiol.* 106:1241-1255 (1994)); and rice (Kurata et al., *Nature Genetics* 8:365-372 (1994)).

III. Sequence Comparisons

A characteristic feature of a DNA sequence is that it can be compared with other DNA sequences. Sequence comparisons can be undertaken by determining the similarity of the test or query sequence with sequences in publicly available or proprietary databases ("similarity analysis") or by searching for certain motifs ("intrinsic sequence analysis")(e.g. cis elements)(Coulson, *Trends in Biotechnology* 12:76-80 (1994), the entirety of which is herein incorporated by reference); Birren et al., *Genome Analysis* 1: Cold Spring Harbor Laboratory Press, Cold Spring Harbor, N.Y. 543-559 (1997), the entirety of which is herein incorporated by reference).

Similarity analysis includes database search and alignment. Examples of public databases include the DNA Database of Japan (DDBJ) (available on the worldwide web at ddbj.nig.ac.jp); Genebank (available on the worldwide web at the ncbi website at: /Web/Search/Index.html); and the European Molecular Biology Laboratory Nucleic Acid Sequence Database (EMBL) (available on the worldwide web at ebi.ac.uk/ebi_docs/embl_db/embl-db.html). Other appropriate databases include dbEST (available on the worldwide web at the ncbi website at:/dbEST /index.html), SwisProt (available on the worldwide web at ebi.ac.uk/ebi_docs/swisprot_db/ swisshome.html), PIR (available on the worldwide web at nbrt.georgetown.edu/pir), and The Institute for Genome Research (available on the worldwide web at tigr.org/tdb/tdb.html).

A number of different search algorithms have been developed, one example of which are the suite of programs referred to as BLAST programs. There are five implementations of BLAST, three designed for nucleotide sequences queries (BLASTN, BLASTX and TBLASTX) and two designed for protein sequence queries (BLASTP and TBLASTN) (Coulson, *Trends in Biotechnology* 12:76-80 (1994); Birren et al, *Genome Analysis* 1, Cold Spring Harbor Laboratory Press, Cold Spring Harbor, N.Y. 543-559 (1997)).

BLASTN takes a nucleotide sequence (the query sequence) and its reverse complement and searches them against a nucleotide sequence database. BLASTN was designed for speed, not maximum sensitivity and may not find distantly related coding sequences. BLASTX takes a nucleotide sequence, translates it in three forward reading frames and three reverse complement reading frames and then compares the six translations against a protein sequence database. BLASTX is useful for sensitive analysis of preliminary (single-pass) sequence data and is tolerant of sequencing errors (Gish and States, *Nature Genetics* 3:266-272 (1993), the entirety of which is herein incorporated by reference). BLASTN and BLASTX may be used in concert for analyzing EST data (Coulson, *Trends in Biotechnology* 12:76-80 (1994); Birren et al., *Genome Analysis* 1:543-559 (1997)).

Given a coding nucleotide sequence and the protein it encodes, it is often preferable to use the protein as the query sequence to search a database because of the greatly increased sensitivity to detect more subtle relationships. This is due to the larger alphabet of proteins (20 amino acids) compared with the alphabet of nucleic acid sequences (4 bases), where it is far easier to obtain a match by chance. In addition, with nucleotide alignments, only a match (positive score) or a mismatch (negative score) is obtained, but with proteins, the presence of conservative amino acid substitutions can be taken into account. Here, a mismatch may yield a positive score if the non-identical residue has physical/chemical properties similar to the one it replaced. Various scoring matrices are used to supply the substitution scores of all possible amino acid pairs. A general purpose scoring system is the BLOSUM62 matrix (Henikoff and Henikoff, *Proteins* 17:49-61 (1993), the entirety of which is herein incorporated by reference), which is currently the default choice for BLAST programs. BLOSUM62 is tailored for alignments of moderately diverged sequences and thus may not yield the best results under all conditions. Altschul, *J. Mol. Biol.* 36:290-300 (1993), the entirety of which is herein incorporated by reference, describes a combination of three matrices to cover all contingencies. This may improve sensitivity, but at the expense of slower searches. In practice, a single BLOSUM62 matrix is often used but others (PAM40 and PAM250) may be attempted when additional analysis is necessary. Low PAM matrices are directed at detecting very strong but localized sequence similarities, whereas high PAM matrices are directed at detecting long but weak alignments between very distantly related sequences.

Homologues in other organisms are available that can be used for comparative sequence analysis. Multiple alignments are performed to study similarities and differences in a group of related sequences. CLUSTAL W is a multiple sequence alignment package that performs progressive multiple sequence alignments based on the method of Feng and Doolittle, *J. Mol. Evol.* 25:351-360 (1987), the entirety of which is herein incorporated by reference. Each pair of sequences is aligned and the distance between each pair is calculated; from this distance matrix, a guide tree is calculated and all of the sequences are progressively aligned based on this tree. A feature of the program is its sensitivity to the effect of gaps on the alignment; gap penalties are varied to encourage the insertion of gaps in probable loop regions instead of in the middle of structured regions. Users can specify gap penalties, choose between a number of scoring matrices, or supply their own scoring matrix for both pairwise alignments and multiple alignments. CLUSTAL W for UNIX and VMS systems is available by anonymous ftp at: ebi.ac.uk. Another program is MACAW (Schuler et al., *Proteins Struct. Func. Genet.* 9:180-190 (1991), the entirety of which is herein incorporated by reference, for which both Macintosh and Microsoft Windows versions are available. MACAW uses a graphical interface, provides a choice of several alignment algorithms and is available by anonymous ftp at the ncbi website at: nlm.nih.gov (directory/pub/macaw).

Sequence motifs are derived from multiple alignments and can be used to examine individual sequences or an entire database for subtle patterns. With motifs, it is sometimes possible to detect distant relationships that may not be demonstrable based on comparisons of primary sequences alone. Currently, the largest collection of sequence motifs in the world is PROSITE (Bairoch and Bucher, *Nucleic Acid Research* 22:3583-3589 (1994), the entirety of which is herein incorporated by reference). PROSITE may be accessed via either the ExPASy server on the World Wide Web or anonymous ftp site. Many commercial sequence analysis packages also provide search programs that use PROSITE data.

A resource for searching protein motifs is the BLOCKS E-mail server developed by Henikoff, *Trends Biochem Sci.* 18:267-268 (1993), the entirety of which is herein incorporated by reference; Henikoff and Henikoff, *Nucleic Acid Research* 19:6565-6572 (1991), the entirety of which is herein incorporated by reference; Henikoff and Henikoff, *Proteins* 17:49-61 (1993). BLOCKS searches a protein or nucleotide sequence against a database of protein motifs or "blocks." Blocks are defined as short, ungapped multiple alignments that represent highly conserved protein patterns. The blocks themselves are derived from entries in PROSITE as well as other sources. Either a protein query or a nucleotide query can be submitted to the BLOCKS server; if a nucleotide sequence is submitted, the sequence is translated in all six reading frames and motifs are sought for these conceptual translations. Once the search is completed, the server will return a ranked list of significant matches, along with an alignment of the query sequence to the matched BLOCKS entries.

Conserved protein domains can be represented by two-dimensional matrices, which measure either the frequency or probability of the occurrences of each amino acid residue and deletions or insertions in each position of the domain. This type of model, when used to search against protein databases, is sensitive and usually yields more accurate results than simple motif searches. Two popular implementations of this approach are profile searches such as GCG program ProfileSearch and Hidden Markov Models (HMMs)(Krough et al., *J. Mol. Biol.* 235:1501-1531, (1994); Eddy, *Current Opinion in Structural Biology* 6:361-365, (1996), both of which are herein incorporated by reference in their entirety). In both cases, a large number of common protein domains have been converted into profiles, as present in the PROSITE library, or HHM models, as in the Pfam protein domain library (Sonnhammer et al., *Proteins* 28:405-420 (1997), the entirety of which is herein incorporated by reference). Pfam contains more than 500 HMM models for enzymes, transcription factors, signal transduction molecules and structural proteins. Protein databases can be queried with these profiles or HMM models, which will identify proteins containing the domain of interest. For example, HMMSW or HMMFS, two programs in a public domain package called HMMER (Sonnhammer et al., *Proteins* 28:405-420 (1997)) can be used.

PROSITE and BLOCKS represent collected families of protein motifs. Thus, searching these databases entails submitting a single sequence to determine whether or not that sequence is similar to the members of an established family. Programs working in the opposite direction compare a collection of sequences with individual entries in the protein databases. An example of such a program is the Motif Search Tool, or MoST (Tatusov et al., *Proc. Natl. Acad. Sci.* (U.S.A.) 91:12091-12095 (1994), the entirety of which is herein incorporated by reference). On the basis of an aligned set of input sequences, a weight matrix is calculated by using one of four methods (selected by the user). A weight matrix is simply a representation, position by position of how likely a particular amino acid will appear. The calculated weight matrix is then used to search the databases. To increase sensitivity, newly found sequences are added to the original data set, the weight matrix is recalculated and the search is performed again. This procedure continues until no new sequences are found.

SUMMARY OF THE INVENTION

The present invention provides a substantially purified nucleic acid molecule that encodes a maize or a soybean enzyme or fragment thereof, wherein the maize or the soybean enzyme is selected from the group consisting of: (a) triose phosphate isomerase; (b) fructose 1,6-bisphosphate aldolase; (c) fructose 1,6-bisphosphate; (d) fructose 6-phosphate 2-kinase; (e) phosphoglucoisomerase; (f) vacuolar $H^+$ translocating-pyrophosphatase; (g) pyrophosphate-dependent fructose-6-phosphate phosphotransferase; (h) invertase; (i) sucrose synthase; (j) hexokinase; (k) fructokinase; (l) NDP-kinase; (m) glucose-6-phosphate 1-dehydrogenase; (n) phosphoglucomutase and (o) UDP-glucose pyrophophorylase.

The present invention also provides a substantially purified nucleic acid molecule that encodes a plant sucrose pathway enzyme or fragment thereof, wherein the nucleic acid molecule is selected from the group consisting of a nucleic acid molecule that encodes a maize or a soybean triose phosphate isomerase enzyme or fragment thereof, a nucleic acid molecule that encodes a maize or a soybean fructose 1,6-bisphosphate aldolase enzyme or fragment thereof, a nucleic acid molecule that encodes a maize or a soybean fructose 1,6-bisphosphate enzyme or fragment thereof, a nucleic acid molecule that encodes a maize or a soybean fructose 6-phosphate 2-kinase enzyme or fragment thereof, a nucleic acid molecule that encodes a maize or a soybean phosphoglucoisomerase enzyme or fragment thereof, a nucleic acid molecule that encodes a maize or a soybean vacuolar $H^+$ translocating-pyrophosphatase enzyme or fragment thereof, a nucleic acid molecule that encodes a maize or a soybean pyrophosphate-dependent fructose-6-phosphate phosphotransferase enzyme or fragment thereof, a nucleic acid molecule that encodes a maize or a soybean invertase enzyme or fragment thereof, a nucleic acid molecule that encodes a maize or a soybean sucrose synthase enzyme or fragment thereof, a nucleic acid molecule that encodes a maize or a soybean hexokinase enzyme or fragment thereof, a nucleic acid molecule that encodes a maize or a soybean fructokinase enzyme or fragment thereof, a nucleic acid molecule that encodes a maize or a soybean NDP-kinase enzyme or fragment thereof, a nucleic acid molecule that encodes a maize or a soybean glucose-6-phosphate 1-dehydrogenase enzyme or fragment thereof, a nucleic acid molecule that encodes a maize or a soybean phosphoglucomutase enzyme or fragment thereof and a nucleic acid molecule that encodes a maize or a soybean UDP-glucose pyrophophorylase enzyme or fragment thereof.

The present invention also provides a substantially purified maize or soybean enzyme or fragment thereof, wherein the maize or soybean enzyme is selected from the group consisting of (a) triose phosphate isomerase; (b) fructose 1,6-bisphosphate aldolase; (c) fructose 1,6-bisphosphate; (d) fructose 6-phosphate 2-kinase; (e) phosphoglucoisomerase; (f) vacuolar $H^+$ translocating-pyrophosphatase; (g) pyrophosphate-dependent fructose-6-phosphate phosphotransferase; (h) invertase; (i) sucrose synthase; (j) hexokinase; (k) fructokinase; (l) NDP-kinase; (m) glucose-6-phosphate 1-dehydrogenase; (n) phosphoglucomutase and (o) UDP-glucose pyrophophorylase.

The present invention also provides a substantially purified maize or soybean sucrose pathway protein or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1 through SEQ ID NO: 2814.

The present invention also provides a substantially purified maize or soybean triose phosphate isomerase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1 through SEQ ID NO: 206 and SEQ ID NO: 1538 through SEQ ID NO: 1707.

The present invention also provides a substantially purified maize or soybean triose phosphate isomerase enzyme or fragment thereof encoded by a nucleic acid sequence selected from the group consisting of SEQ ID NO: 1 through SEQ ID NO: 206 and SEQ ID NO: 1538 through SEQ ID NO: 1707.

The present invention also provides a substantially purified maize or soybean fructose 1,6-bisphosphate aldolase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 207 through SEQ ID NO: 232 and SEQ ID NO: 1708 through SEQ ID NO: 2113.

The present invention also provides a substantially purified maize or soybean fructose 1,6-bisphosphate aldolase enzyme or fragment thereof encoded by a nucleic acid sequence selected from the group consisting SEQ ID NO: 207 through SEQ ID NO: 232 and SEQ ID NO: 1708 through SEQ ID NO: 2113.

The present invention also provides a substantially purified maize or soybean fructose 1,6-bisphosphate enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 233 through SEQ ID NO: 258 and SEQ ID NO: 2114 through SEQ ID NO: 2162.

The present invention also provides a substantially purified maize or soybean fructose 1,6-bisphosphate e enzyme or fragment thereof encoded by a nucleic acid sequence selected from the group consisting of SEQ ID NO: 233 through SEQ ID NO: 258 and SEQ ID NO: 2114 through SEQ ID NO: 2162.

The present invention also provides a substantially purified maize or soybean fructose 6-phosphate 2-kinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 259 through SEQ ID NO: 275 and SEQ ID NO: 2163 through SEQ ID NO: 2166.

The present invention also provides a substantially purified maize or soybean fructose 6-phosphate 2-kinase enzyme or fragment thereof encoded by a nucleic acid sequence selected from the group consisting of SEQ ID NO: 259 through SEQ ID NO: 275 and SEQ ID NO: 2163 through SEQ ID NO: 2166.

The present invention also provides a substantially purified maize or soybean phosphoglucoisomerase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 276 through SEQ ID NO: 340 and SEQ ID NO: 2167 through SEQ ID NO: 2182.

The present invention also provides a substantially purified maize or soybean phosphoglucoisomerase enzyme or fragment thereof encoded by a nucleic acid sequence selected from the group consisting of SEQ ID NO: 276 through SEQ ID NO: 340 and SEQ ID NO: 2167 through SEQ ID NO: 2182.

The present invention also provides a substantially purified maize or soybean vacuolar $H^+$ translocating-pyrophosphatase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 341 through SEQ ID NO: 497 and SEQ ID NO: 2183 through SEQ ID NO: 2241.

The present invention also provides a substantially purified maize or soybean vacuolar $H^+$ translocating-pyrophosphatase enzyme or fragment thereof encoded by a nucleic acid sequence selected from the group consisting of SEQ ID NO: 341 through SEQ ID NO: 497 and SEQ ID NO: 2183 through SEQ ID NO: 2241.

The present invention also provides a substantially purified maize or soybean pyrophosphate-dependent fructose-6-phosphate phosphotransferase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 498 through SEQ ID NO: 507 and SEQ ID NO: 2442.

The present invention also provides a substantially purified maize or soybean pyrophosphate-dependent fructose-6-phosphate phosphotransferase enzyme or fragment thereof encoded by a nucleic acid sequence selected from the group consisting of SEQ ID NO: 498 through SEQ ID NO: 507 and SEQ ID NO: 2442.

The present invention also provides a substantially purified maize or soybean invertase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 508 through SEQ ID NO: 510 and SEQ ID NO: 2243 through SEQ ID NO: 2254.

The present invention also provides a substantially purified maize or soybean invertase enzyme or fragment thereof encoded by a nucleic acid sequence selected from the group consisting of SEQ ID NO: 508 through SEQ ID NO: 510 and SEQ ID NO: 2243 through SEQ ID NO:2254.

The present invention also provides a substantially purified maize or soybean sucrose synthase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 511 through SEQ ID NO: 1086 and SEQ ID NO: 2255 through SEQ ID NO: 2590.

The present invention also provides a substantially purified maize or soybean sucrose synthase enzyme or fragment thereof encoded by a nucleic acid sequence selected from the group consisting of SEQ ID NO: 511 through SEQ ID NO: 1086 and SEQ ID NO: 2255 through SEQ ID NO: 2590.

The present invention also provides a substantially purified maize or soybean hexokinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1087 through SEQ ID NO: 1135 and SEQ ID NO: 2591 through SEQ ID NO: 2634.

The present invention also provides a substantially purified maize or soybean hexokinase enzyme or fragment thereof encoded by a nucleic acid sequence selected from the group consisting of SEQ ID NO: 1087 through SEQ ID NO: 1135 and SEQ ID NO: 2591 through SEQ ID NO: 2634.

The present invention also provides a substantially purified maize or soybean fructokinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1136 through SEQ ID NO: 1215 and SEQ ID NO: 2635 through SEQ ID NO: 2678.

The present invention also provides a substantially purified maize or soybean fructokinase enzyme or fragment thereof encoded by a nucleic acid sequence selected from the group consisting of SEQ ID NO: 1136 through SEQ ID NO: 1215 and SEQ ID NO: 2635 through SEQ ID NO: 2678.

The present invention also provides a substantially purified maize or soybean NDP-kinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1216 through SEQ ID NO: 1251 and SEQ ID NO: 2679 through SEQ ID NO: 2681.

The present invention also provides a substantially purified maize or soybean NDP-kinase e enzyme or fragment thereof encoded by a nucleic acid sequence selected from the group consisting of SEQ ID NO: 1216 through SEQ ID NO: 1251 and SEQ ID NO: 2679 through SEQ ID NO: 2681.

The present invention also provides a substantially purified maize or soybean glucose-6-phosphate 1-dehydrogenase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1252 through SEQ ID NO: 1254 and SEQ ID NO: 2682 through SEQ ID NO: 2689.

The present invention also provides a substantially purified maize or soybean glucose-6-phosphate 1-dehydrogenase enzyme or fragment thereof encoded by a nucleic acid sequence selected from the group consisting of SEQ ID NO: 1252 through SEQ ID NO: 1254 and SEQ ID NO: 2682 through SEQ ID NO: 2689.

The present invention also provides a substantially purified maize or soybean phosphoglucomutase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1255 through SEQ ID NO: 1360 and SEQ ID NO: 2690 through SEQ ID NO: 2740.

The present invention also provides a substantially purified maize or soybean phosphoglucomutase enzyme or fragment thereof encoded by a nucleic acid sequence selected from the group consisting of SEQ ID NO: 1255 through SEQ ID NO: 1360 and SEQ ID NO: 2690 through SEQ ID NO: 2740.

The present invention also provides a substantially purified maize or soybean UDP-glucose pyrophophorylase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1361 through SEQ ID NO: 1537 and SEQ ID NO: 2741 through SEQ ID NO: 2814.

The present invention also provides a substantially purified maize or soybean UDP-glucose pyrophophorylase enzyme or fragment thereof encoded by a nucleic acid sequence selected from the group consisting of SEQ ID NO: 1361 through SEQ ID NO: 1537 and SEQ ID NO: 2741 through SEQ ID NO: 2814.

The present invention also provides a purified antibody or fragment thereof which is capable of specifically binding to a maize or soybean enzyme or fragment thereof, wherein the maize or soybean enzyme or fragment thereof is encoded by a nucleic acid molecule comprising a nucleic acid sequence selected from the group consisting of consisting of SEQ ID NO: 1 through SEQ ID NO: 2814.

The present invention also provides a substantially purified antibody or fragment thereof, the antibody or fragment thereof capable of specifically binding to a maize or a soybean triose phosphate isomerase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1 through SEQ ID NO: 206 and SEQ ID NO: 1538 through SEQ ID NO: 1707 and a maize or soybean triose phosphate isomerase enzyme or fragment thereof encoded by a nucleic acid sequence selected from the group consisting of SEQ ID NO: 1 through SEQ ID NO: 206 and SEQ ID NO: 1538 through SEQ ID NO: 1707.

The present invention also provides a substantially purified antibody or fragment thereof, the antibody or fragment thereof capable of specifically binding to a maize or a soybean fructose 1,6-bisphosphate aldolase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 207 through SEQ ID NO: 232 and SEQ ID NO: 1708 through SEQ ID NO: 2113 and a maize or soybean fructose 1,6-bisphosphate aldolase enzyme or fragment thereof encoded by a nucleic acid sequence selected from the group consisting of SEQ ID NO: 207 through SEQ ID NO: 232 and SEQ ID NO: 1708 through SEQ ID NO: 2113.

The present invention also provides a substantially purified antibody or fragment thereof, the antibody or fragment thereof capable of specifically binding to a maize or a soybean fructose 1,6-bisphosphate enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 233 through SEQ ID NO: 258 and SEQ ID NO: 2114 through SEQ ID NO: 2162 and a maize or soybean fructose 1,6-bisphosphate enzyme or fragment thereof encoded by a nucleic acid sequence selected from the group consisting of SEQ ID NO: 233 through SEQ ID NO: 258 and SEQ ID NO: 2114 through SEQ ID NO: 2162.

The present invention also provides a substantially purified antibody or fragment thereof, the antibody or fragment thereof capable of specifically binding to a maize or a soybean fructose 6-phosphate 2-kinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID SEQ ID NO: 259 through SEQ ID NO: 275 and SEQ ID NO: 2163 through SEQ ID NO: 2166 and a maize or soybean fructose 6-phosphate 2-kinase enzyme or fragment thereof encoded by a nucleic acid sequence selected from the group consisting of SEQ ID NO: 259 through SEQ ID NO: 275 and SEQ ID NO: 2163 through SEQ ID NO: 2166.

The present invention also provides a substantially purified antibody or fragment thereof, the antibody or fragment thereof capable of specifically binding to a maize or a soybean phosphoglucoisomerase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 276 through SEQ ID NO: 340 and SEQ ID NO: 2167 through SEQ ID NO: 2182 and a maize or soybean phosphoglucoisomerase enzyme or fragment thereof encoded by a nucleic acid sequence selected from the group consisting of SEQ ID NO: 276 through SEQ ID NO: 340 and SEQ ID NO: 2167 through SEQ ID NO: 2182.

The present invention also provides a substantially purified antibody or fragment thereof, the antibody or fragment thereof capable of specifically binding to a maize or a soybean vacuolar $H^+$ translocating-pyrophosphatase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 341 through SEQ ID NO: 497 and SEQ ID NO: 2183 through SEQ ID NO: 2241 and a maize or soybean vacuolar $H^+$ translocating-pyrophosphatase enzyme or fragment thereof encoded by a nucleic acid sequence selected from the group consisting of SEQ ID NO: 341 through SEQ ID NO: 497 and SEQ ID NO: 2183 through SEQ ID NO: 2241.

The present invention also provides a substantially purified antibody or fragment thereof, the antibody or fragment thereof capable of specifically binding to a maize or a soybean pyrophosphate-dependent fructose-6-phosphate phosphotransferase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 498 through SEQ ID NO: 507 and SEQ ID NO: 2442 and a maize or soybean pyrophosphate-dependent fructose-6-phosphate phosphotransferase enzyme or fragment thereof encoded by a nucleic acid sequence selected from the group consisting of SEQ ID NO: 498 through SEQ ID NO: 507 and SEQ ID NO: 2442.

The present invention also provides a substantially purified antibody or fragment thereof, the antibody or fragment thereof capable of specifically binding to a maize or a soybean invertase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 508 through SEQ ID NO: 510 and SEQ ID NO: 2243 through SEQ ID NO: 2254 and a maize or soybean invertase enzyme or fragment thereof encoded by a nucleic acid sequence selected from the group consisting of SEQ ID NO: 508 through SEQ ID NO: 510 and SEQ ID NO: 2243 through SEQ ID NO: 2254.

The present invention also provides a substantially purified antibody or fragment thereof, the antibody or fragment thereof capable of specifically binding to a maize or a soybean sucrose synthase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 511 through SEQ ID NO: 1086 and SEQ ID NO: 2255 through SEQ ID NO: 2590 and a maize or soybean sucrose synthase enzyme or fragment thereof encoded by a nucleic acid sequence selected from the group consisting of SEQ ID NO: 511 through SEQ ID NO: 1086 and SEQ ID NO: 2255 through SEQ ID NO: 2590.

The present invention also provides a substantially purified antibody or fragment thereof, the antibody or fragment thereof capable of specifically binding to a maize or a soybean hexokinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1087 through SEQ ID NO: 1135 and SEQ ID NO: 2591 through SEQ ID NO: 2634 and a maize or soybean hexokinase enzyme or fragment thereof encoded by a nucleic acid sequence selected from the group consisting of SEQ ID NO: 1087 through SEQ ID NO: 1135 and SEQ ID NO: 2591 through SEQ ID NO: 2634.

The present invention also provides a substantially purified antibody or fragment thereof, the antibody or fragment thereof capable of specifically binding to a maize or a soybean fructokinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1136 through SEQ ID NO: 1215 and SEQ ID NO: 2635 through SEQ ID NO: 2678 and a maize or soybean fructokinase enzyme or fragment thereof encoded by a nucleic acid sequence selected from the group consisting of SEQ ID NO: 1136 through SEQ ID NO: 1215 and SEQ ID NO: 2635 through SEQ ID NO: 2678.

The present invention also provides a substantially purified antibody or fragment thereof, the antibody or fragment thereof capable of specifically binding to a maize or a soybean NDP-kinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1216 through SEQ ID NO: 1251 and SEQ ID NO: 2679 through SEQ ID NO: 2681 and a maize or soybean NDP-kinase enzyme or fragment thereof encoded by a nucleic acid sequence selected from the group consisting of SEQ ID NO: 1216 through SEQ ID NO: 1251 and SEQ ID NO: 2679 through SEQ ID NO: 2681.

The present invention also provides a substantially purified antibody or fragment thereof, the antibody or fragment thereof capable of specifically binding to a maize or a soybean glucose-6-phosphate 1-dehydrogenase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1252 through SEQ ID NO: 1254 and SEQ ID NO: 2682 through SEQ ID NO: 2689 and a maize or soybean glucose-6-phosphate 1-dehydrogenase enzyme or fragment thereof encoded by a nucleic acid sequence selected from the group consisting of SEQ ID NO: 1252 through SEQ ID NO: 1254 and SEQ ID NO: 2682 through SEQ ID NO: 2689.

The present invention also provides a substantially purified antibody or fragment thereof, the antibody or fragment thereof capable of specifically binding to a maize or a soybean phosphoglucomutase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1255 through SEQ ID NO: 1360 and SEQ ID NO: 2690 through SEQ ID NO: 2740 and a maize or soybean phosphoglucomutase enzyme or fragment thereof encoded by a nucleic acid sequence selected from the group consisting of SEQ ID NO: 1255 through SEQ ID NO: 1360 and SEQ ID NO: 2690 through SEQ ID NO: 2740.

The present invention also provides a substantially purified antibody or fragment thereof, the antibody or fragment thereof capable of specifically binding to a maize or a soybean UDP-glucose pyrophophorylase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1361 through SEQ ID NO: 1537 and SEQ ID NO: 2741 through SEQ ID NO: 2814 and a maize or soybean UDP-glucose pyrophophorylase enzyme or fragment thereof encoded by a nucleic acid sequence selected from the group consisting of SEQ ID NO: 1361 through SEQ ID NO: 1537 and SEQ ID NO: 2741 through SEQ ID NO: 2814.

The present invention also provides a transformed plant having a nucleic acid molecule which comprises: (A) an exogenous promoter region which functions in a plant cell to cause the production of a mRNA molecule; (B) a structural nucleic acid molecule comprising a nucleic acid sequence selected from the group consisting of (a) a nucleic acid sequence which encodes for triose phosphate isomerase or fragment thereof; (b) a nucleic acid sequence which encodes for fructose 1,6-bisphosphate aldolase or fragment thereof; (c) a nucleic acid sequence which encodes for fructose 1,6-bisphosphate or fragment thereof; (d) a nucleic acid sequence which encodes for fructose 6-phosphate 2-kinase or fragment thereof; (e) a nucleic acid sequence which encodes for phosphoglucoisomerase or fragment thereof; (f) a nucleic acid sequence which encodes for vacuolar $H^+$ translocating-pyrophosphatase or fragment thereof; (g) a nucleic acid sequence which encodes for pyrophosphate-dependent fructose-6-phosphate phosphotransferase or fragment thereof; (h) a nucleic acid sequence which encodes for invertase or fragment thereof; (i) a nucleic acid sequence which encodes for sucrose synthase or fragment thereof; (j) a nucleic acid sequence which encodes for hexokinase or fragment thereof; (k) a nucleic acid sequence which encodes for fructokinase or fragment thereof; (l) a nucleic acid sequence which encodes for NDP-kinase or fragment thereof; (m) a nucleic acid sequence which encodes for glucose-6-phosphate 1-dehydrogenase or fragment thereof; (n) a nucleic acid sequence which encodes for phosphoglucomutase or fragment thereof (o) a nucleic acid sequence which encodes for UDP-glucose pyrophophorylase or fragment thereof and (p) a nucleic acid sequence which is complementary to any of the nucleic acid sequences of (a) through (o); and (C) a 3' non-translated sequence that functions in the plant cell to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of a mRNA molecule; which is linked to (B) a structural nucleic acid molecule, wherein the structural nucleic acid molecule encodes a plant sucrose pathway enzyme or fragment thereof, the structural nucleic acid molecule comprising a nucleic acid sequence selected from the group consisting of SEQ ID NO: 1 through SEQ ID NO: 2814 or fragment thereof; which is linked to (C) a 3' non-translated sequence that functions in the plant cell to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of a mRNA molecule; which is linked to (B) a structural nucleic acid molecule, wherein the structural nucleic acid molecule is selected from the group consisting of a nucleic acid molecule that encodes a maize or a soybean triose phosphate isomerase enzyme or fragment thereof, a nucleic acid molecule that encodes a maize or a soybean fructose 1,6-bisphosphate aldolase enzyme or fragment thereof, a nucleic acid molecule that encodes a maize or a soybean fructose 1,6-bisphosphate enzyme or fragment thereof, a nucleic acid molecule that encodes a maize or a soybean fructose 6-phosphate 2-kinase enzyme or fragment thereof, a nucleic acid molecule that encodes a maize or a soybean phosphoglucoisomerase enzyme or fragment thereof, a nucleic acid molecule that encodes a maize or a soybean vacuolar H$^+$ translocating-pyrophosphatase enzyme or fragment thereof, a nucleic acid molecule that encodes a maize or a soybean pyrophosphate-dependent fructose-6-phosphate phosphotransferase enzyme or fragment thereof, a nucleic acid molecule that encodes a maize or a soybean invertase enzyme or fragment thereof, a nucleic acid molecule that encodes a maize or a soybean sucrose synthase enzyme or fragment thereof, a nucleic acid molecule that encodes a maize or a soybean hexokinase enzyme or fragment thereof, a nucleic acid molecule that encodes a maize or a soybean fructokinase enzyme or fragment thereof a nucleic acid molecule that encodes a maize or a soybean NDP-kinase enzyme or fragment thereof, a nucleic acid molecule that encodes a maize or a soybean glucose-6-phosphate 1-dehydrogenase enzyme or fragment thereof, a nucleic acid molecule that encodes a maize or a soybean phosphoglucomutase enzyme or fragment thereof and a nucleic acid molecule that encodes a maize or a soybean UDP-glucose pyrophophorylase enzyme or fragment thereof, which is linked to (C) a 3' non-translated sequence that functions in the plant cell to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of a mRNA molecule; which is linked to (B) a transcribed nucleic acid molecule with a transcribed strand and a non-transcribed strand, wherein the transcribed strand is complementary to a nucleic acid molecule comprising a nucleic acid sequence selected from the group consisting of SEQ ID NO: 1 through SEQ ID NO: 2814 or fragment thereof; which is linked to (C) a 3' non-translated sequence that functions in plant cells to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of a mRNA molecule; which is linked to: (B) a transcribed nucleic acid molecule with a transcribed strand and a non-transcribed strand, wherein a transcribed mRNA of the transcribed strand is complementary to an endogenous mRNA molecule having a nucleic acid sequence selected from the group consisting of an endogenous mRNA molecule that encodes a maize or a soybean triose phosphate isomerase enzyme or fragment thereof, an endogenous mRNA molecule that encodes a maize or a soybean fructose 1,6-bisphosphate aldolase enzyme or fragment thereof, an endogenous mRNA molecule that encodes a maize or a soybean fructose 1,6-bisphosphate enzyme or fragment thereof, an endogenous mRNA molecule that encodes a maize or a soybean fructose 6-phosphate 2-kinase enzyme or fragment thereof, an endogenous mRNA molecule that encodes a maize or a soybean phosphoglucoisomerase enzyme or fragment thereof, an endogenous mRNA molecule that encodes a maize or a soybean vacuolar H$^+$ translocating-pyrophosphatase enzyme or fragment thereof, an endogenous mRNA molecule that encodes a maize or a soybean pyrophosphate-dependent fructose-6-phosphate phosphotransferase enzyme or fragment thereof, an endogenous mRNA molecule that encodes a maize or a soybean invertase enzyme or fragment thereof, an endogenous mRNA molecule that encodes a maize or a soybean sucrose synthase enzyme or fragment thereof, an endogenous mRNA molecule that encodes a maize or a soybean hexokinase enzyme or fragment thereof, an endogenous mRNA molecule that encodes a maize or a soybean fructokinase enzyme or fragment thereof, an endogenous mRNA molecule that encodes a maize or a soybean NDP-kinase enzyme or fragment thereof, an endogenous mRNA molecule that encodes a maize or a soybean glucose-6-phosphate 1-dehydrogenase enzyme or fragment thereof, an endogenous mRNA molecule that encodes a maize or a soybean phosphoglucomutase enzyme or fragment thereof and an endogenous mRNA molecule that encodes a maize or a soybean UDP-glucose pyrophophorylase enzyme or fragment thereof, which is linked to (C) a 3' non-translated sequence that functions in the plant cell to cause termination of transcription and addition of polyadenylated ribonucleotides to a 3' end of the mRNA molecule.

The present invention also provides a method for determining a level or pattern in a plant cell of an enzyme in a plant metabolic pathway comprising: (A) incubating, under conditions permitting nucleic acid hybridization, a marker nucleic acid molecule, the marker nucleic acid molecule selected from the group of marker nucleic acid molecules which specifically hybridize to a nucleic acid molecule having the nucleic acid sequence of SEQ ID NO: 1 through SEQ ID NO:

2814 or compliments thereof, with a complementary nucleic acid molecule obtained from the plant cell or plant tissue, wherein nucleic acid hybridization between the marker nucleic acid molecule and the complementary nucleic acid molecule obtained from the plant cell or plant tissue permits the detection of an mRNA for the enzyme; (B) permitting hybridization between the marker nucleic acid molecule and the complementary nucleic acid molecule obtained from the plant cell or plant tissue; and (C) detecting the level or pattern of the complementary nucleic acid, wherein the detection of the complementary nucleic acid is predictive of the level or pattern of the enzyme in the plant metabolic pathway.

The present invention also provides a method for determining a level or pattern of a plant sucrose pathway enzyme in a plant cell or plant tissue comprising: (A) incubating, under conditions permitting nucleic acid hybridization, a marker nucleic acid molecule, the marker nucleic acid molecule having a nucleic acid sequence selected from the group consisting of SEQ ID NO: 1 through SEQ ID NO: 2814 or complements thereof or fragment of either, with a complementary nucleic acid molecule obtained from the plant cell or plant tissue, wherein nucleic acid hybridization between the marker nucleic acid molecule and the complementary nucleic acid molecule obtained from the plant cell or plant tissue permits the detection of the plant sucrose pathway enzyme; (B) permitting hybridization between the marker nucleic acid molecule and the complementary nucleic acid molecule obtained from the plant cell or plant tissue; and (C) detecting the level or pattern of the complementary nucleic acid, wherein the detection of the complementary nucleic acid is predictive of the level or pattern of the plant sucrose pathway enzyme.

The present invention also provides a method for determining a level or pattern of a plant sucrose pathway enzyme in a plant cell or plant tissue comprising: (A) incubating, under conditions permitting nucleic acid hybridization, a marker nucleic acid molecule, the marker nucleic acid molecule comprising a nucleic acid molecule that encodes a maize or a soybean triose phosphate isomerase enzyme or complement thereof or fragment of either, a nucleic acid molecule that encodes a maize or a soybean fructose 1,6-bisphosphate aldolase enzyme or complement thereof or fragment of either, a nucleic acid molecule that encodes a maize or a soybean fructose 1,6-bisphosphate enzyme or complement thereof or fragment of either, a nucleic acid molecule that encodes a maize or a soybean fructose 6-phosphate 2-kinase enzyme or complement thereof or fragment of either, a nucleic acid molecule that encodes a maize or a soybean phosphoglucoisomerase enzyme or complement thereof or fragment of either, a nucleic acid molecule that encodes a maize or a soybean vacuolar H$^+$ translocating-pyrophosphatase enzyme or complement thereof or fragment of either, a nucleic acid molecule that encodes a maize or a soybean pyrophosphate-dependent fructose-6-phosphate phosphotransferase enzyme or complement thereof or fragment of either, a nucleic acid molecule that encodes a maize or a soybean invertase enzyme or complement thereof or fragment of either, a nucleic acid molecule that encodes a maize or a soybean sucrose synthase enzyme or complement thereof or fragment of either, a nucleic acid molecule that encodes a maize or a soybean hexokinase enzyme or complement thereof or fragment of either, a nucleic acid molecule that encodes a maize or a soybean fructokinase enzyme or complement thereof or fragment of either f, a nucleic acid molecule that encodes a maize or a soybean NDP-kinase enzyme or complement thereof or fragment of either, a nucleic acid molecule that encodes a maize or a soybean glucose-6-phosphate 1-dehydrogenase enzyme or complement thereof or fragment of either, a nucleic acid molecule that encodes a maize or a soybean phosphoglucomutase enzyme or complement thereof or fragment of either and a nucleic acid molecule that encodes a maize or a soybean UDP-glucose pyrophophorylase enzyme or complement thereof or fragment of either, with a complementary nucleic acid molecule obtained from the plant cell or plant tissue, wherein nucleic acid hybridization between the marker nucleic acid molecule and the complementary nucleic acid molecule obtained from the plant cell or plant tissue permits the detection of the plant sucrose pathway enzyme; (B) permitting hybridization between the marker nucleic acid molecule and the complementary nucleic acid molecule obtained from the plant cell or plant tissue; and (C) detecting the level or pattern of the complementary nucleic acid, wherein the detection of the complementary nucleic acid is predictive of the level or pattern of the plant sucrose pathway enzyme.

The present invention also provides a method for determining a level or pattern of a plant sucrose pathway enzyme in a plant cell or plant tissue under evaluation which comprises assaying the concentration of a molecule, whose concentration is dependent upon the expression of a gene, the gene specifically hybridizes to a nucleic acid molecule having a nucleic acid sequence selected from the group consisting of SEQ ID NO: 1 through SEQ ID NO: 2814 or complements thereof, in comparison to the concentration of that molecule present in a reference plant cell or a reference plant tissue with a known level or pattern of the plant sucrose pathway enzyme, wherein the assayed concentration of the molecule is compared to the assayed concentration of the molecule in the reference plant cell or reference plant tissue with the known level or pattern of the plant sucrose pathway enzyme.

The present invention also provides a method for determining a level or pattern of a plant sucrose pathway enzyme in a plant cell or plant tissue under evaluation which comprises assaying the concentration of a molecule, whose concentration is dependent upon the expression of a gene, the gene specifically hybridizes to a nucleic acid molecule selected from the group consisting of a nucleic acid molecule that encodes a maize or a soybean triose phosphate isomerase enzyme or complement thereof, a nucleic acid molecule that encodes a maize or a soybean fructose 1,6-bisphosphate aldolase enzyme or complement thereof, a nucleic acid molecule that encodes a maize or a soybean fructose 1,6-bisphosphate enzyme or complement thereof, a nucleic acid molecule that encodes a maize or a soybean fructose 6-phosphate 2-kinase enzyme or complement thereof, a nucleic acid molecule that encodes a maize or a soybean phosphoglucoisomerase enzyme or complement thereof, a nucleic acid molecule that encodes a maize or a soybean vacuolar H$^+$ translocating-pyrophosphatase enzyme or complement thereof, a nucleic acid molecule that encodes a maize or a soybean pyrophosphate-dependent fructose-6-phosphate phosphotransferase enzyme or complement thereof, a nucleic acid molecule that encodes a maize or a soybean invertase enzyme or complement thereof, a nucleic acid molecule that encodes a maize or a soybean sucrose synthase enzyme or complement thereof, a nucleic acid molecule that encodes a maize or a soybean hexokinase enzyme or complement thereof, a nucleic acid molecule that encodes a maize or a soybean fructokinase enzyme or complement thereof, a nucleic acid molecule that encodes a maize or a soybean NDP-kinase enzyme or complement thereof, a nucleic acid molecule that encodes a maize or a soybean glucose-6-phosphate 1-dehydrogenase enzyme or complement thereof, a nucleic acid molecule that encodes a maize or a soybean phosphoglucomutase enzyme or complement thereof and a nucleic acid molecule that encodes a maize or a soybean UDP-glucose pyrophophorylase enzyme or complement thereof, in comparison to the concentration of that molecule present in a reference plant cell or a reference plant tissue with a known level or pattern of the plant sucrose pathway enzyme, wherein the assayed concentration of the molecule is compared to the assayed concentration of the molecule in the reference plant cell or the reference plant tissue with the known level or pattern of the plant sucrose pathway enzyme.

The present invention provides a method of determining a mutation in a plant whose presence is predictive of a mutation affecting a level or pattern of a protein comprising the steps: (A) incubating, under conditions permitting nucleic acid hybridization, a marker nucleic acid, the marker nucleic acid selected from the group of marker nucleic acid molecules which specifically hybridize to a nucleic acid molecule having a nucleic acid sequence selected from the group of SEQ ID NO: 1 through SEQ ID NO: 2814 or complements thereof and a complementary nucleic acid molecule obtained from the plant, wherein nucleic acid hybridization between the marker nucleic acid molecule and the complementary nucleic acid molecule obtained from the plant permits the detection of a polymorphism whose presence is predictive of a mutation affecting the level or pattern of the plant sucrose pathway enzyme in the plant; (B) permitting hybridization between the marker nucleic acid molecule and the complementary nucleic acid molecule obtained from the plant; and (C) detecting the presence of the polymorphism, wherein the detection of the polymorphism is predictive of the mutation.

The present invention also provides a method for determining a mutation in a plant whose presence is predictive of a mutation affecting the level or pattern of a plant sucrose pathway enzyme comprising the steps: (A) incubating, under conditions permitting nucleic acid hybridization, a marker nucleic acid molecule, the marker nucleic acid molecule comprising a nucleic acid molecule that is linked to a gene, the gene specifically hybridizes to a nucleic acid molecule having a nucleic acid sequence selected from the group consisting of SEQ ID NO: 1 through SEQ ID NO: 2814 or complements thereof and a complementary nucleic acid molecule obtained from the plant, wherein nucleic acid hybridization between the marker nucleic acid molecule and the complementary nucleic acid molecule obtained from the plant permits the detection of a polymorphism whose presence is predictive of a mutation affecting the level or pattern of the plant sucrose pathway enzyme in the plant; (B) permitting hybridization between the marker nucleic acid molecule and the complementary nucleic acid molecule obtained from the plant; and (C) detecting the presence of the polymorphism, wherein the detection of the polymorphism is predictive of the mutation.

The present invention also provides a method for determining a mutation in a plant whose presence is predictive of a mutation affecting the level or pattern of a plant sucrose pathway enzyme comprising the steps: (A) incubating, under conditions permitting nucleic acid hybridization, a marker nucleic acid molecule, the marker nucleic acid molecule comprising a nucleic acid molecule that is linked to a gene, the gene specifically hybridizes to a nucleic acid molecule selected from the group consisting of a nucleic acid molecule that encodes a maize or a soybean triose phosphate isomerase enzyme or complement thereof, a nucleic acid molecule that encodes a maize or a soybean fructose 1,6-bisphosphate aldolase enzyme or complement thereof, a nucleic acid molecule that encodes a maize or a soybean fructose 1,6-bisphosphate enzyme or complement thereof, a nucleic acid molecule that encodes a maize or a soybean fructose 6-phosphate 2-kinase enzyme or complement thereof, a nucleic acid molecule that encodes a maize or a soybean phosphoglucoisomerase enzyme or complement thereof, a nucleic acid molecule that encodes a maize or a soybean vacuolar $H^+$ translocating-pyrophosphatase enzyme or complement thereof, a nucleic acid molecule that encodes a maize or a soybean pyrophosphate-dependent fructose-6-phosphate phosphotransferase enzyme or complement thereof, a nucleic acid molecule that encodes a maize or a soybean invertase enzyme or complement thereof, a nucleic acid molecule that encodes a maize or a soybean sucrose synthase enzyme or complement thereof, a nucleic acid molecule that encodes a maize or a soybean hexokinase enzyme or complement thereof, a nucleic acid molecule that encodes a maize or a soybean fructokinase enzyme or complement thereof, a nucleic acid molecule that encodes a maize or a soybean NDP-kinase enzyme or complement thereof, a nucleic acid molecule that encodes a maize or a soybean glucose-6-phosphate 1-dehydrogenase enzyme or complement thereof, a nucleic acid molecule that encodes a maize or a soybean phosphoglucomutase enzyme or complement thereof and a nucleic acid molecule that encodes a maize or a soybean UDP-glucose pyrophophorylase enzyme or complement thereof and a complementary nucleic acid molecule obtained from the plant, wherein nucleic acid hybridization between the marker nucleic acid molecule and the complementary nucleic acid molecule obtained from the plant permits the detection of a polymorphism whose presence is predictive of a mutation affecting the level or pattern of the plant sucrose pathway enzyme in the plant; (B) permitting hybridization between the marker nucleic acid molecule and the complementary nucleic acid molecule obtained from the plant; and (C) detecting the presence of the polymorphism, wherein the detection of the polymorphism is predictive of the mutation.

The present invention also provides a method of producing a plant containing an overexpressed protein comprising: (A) transforming the plant with a functional nucleic acid molecule, wherein the functional nucleic acid molecule comprises a promoter region, wherein the promoter region is linked to a structural region, wherein the structural region has a nucleic acid sequence selected from group consisting of SEQ ID NO: 1 through SEQ ID NO: 2814 wherein the structural region is linked to a 3' non-translated sequence that functions in the plant to cause termination of transcription and addition of polyadenylated ribonucleotides to a 3' end of a mRNA molecule; and wherein the functional nucleic acid molecule results in overexpression of the protein; and (B) growing the transformed plant.

The present invention also provides a method of producing a plant containing an overexpressed plant sucrose enzyme comprising: (A) transforming the plant with a functional nucleic acid molecule, wherein the functional nucleic acid molecule comprises a promoter region, wherein the promoter region is linked to a structural region, wherein the structural region comprises a nucleic acid molecule having a nucleic acid sequence selected from the group consisting of SEQ ID NO: 1 through SEQ ID NO: 2814 or fragment thereof; wherein the structural region is linked to a 3' non-translated sequence that functions in the plant to cause termination of transcription and addition of polyadenylated ribonucleotides to a 3' end of a mRNA molecule; and wherein the functional nucleic acid molecule results in overexpression of the plant sucrose pathway enzyme; and (B) growing the transformed plant.

The present invention also provides a method of producing a plant containing an overexpressed plant sucrose pathway enzyme comprising: (A) transforming the plant with a functional nucleic acid molecule, wherein the functional nucleic acid molecule comprises a promoter region, wherein the promoter region is linked to a structural region, wherein the structural region comprises a nucleic acid molecule selected from the group consisting of a nucleic acid molecule that encodes a maize or a soybean triose phosphate isomerase enzyme or fragment thereof, a nucleic acid molecule that encodes a maize or a soybean fructose 1,6-bisphosphate aldolase enzyme or fragment thereof, a nucleic acid molecule that encodes a maize or a soybean fructose 1,6-bisphosphate enzyme or fragment thereof, a nucleic acid molecule that encodes a maize or a soybean fructose 6-phosphate 2-kinase enzyme or fragment thereof, a nucleic acid molecule that encodes a maize or a soybean phosphoglucoisomerase enzyme or fragment thereof, a nucleic acid molecule that encodes a maize or a soybean vacuolar $H^+$ translocating-pyrophosphatase enzyme or fragment thereof, a nucleic acid molecule that encodes a maize or a soybean pyrophosphate-dependent fructose-6-phosphate phosphotransferase enzyme or fragment thereof, a nucleic acid molecule that encodes a maize or a soybean invertase enzyme or fragment thereof, a nucleic acid molecule that encodes a maize or a soybean sucrose synthase enzyme or fragment thereof, a nucleic acid molecule that encodes a maize or a soybean hexokinase enzyme or fragment thereof, a nucleic acid molecule that encodes a maize or a soybean fructokinase enzyme or fragment thereof, a nucleic acid molecule that encodes a maize or a soybean NDP-kinase enzyme or fragment thereof, a nucleic acid molecule that encodes a maize or a soybean glucose-6-phosphate 1-dehydrogenase enzyme or fragment thereof, a nucleic acid molecule that encodes a maize or a soybean phosphoglucomutase enzyme or fragment thereof and a nucleic acid molecule that encodes a maize or a soybean UDP-glucose pyrophophorylase enzyme or fragment thereof, wherein the structural region is linked to a 3' non-translated sequence that functions in the plant to cause termination of transcription and addition of polyadenylated ribonucleotides to a 3' end of a mRNA molecule; and wherein the functional nucleic acid molecule results in co-suppression of the plant sucrose pathway enzyme protein; and (B) growing the transformed plant.

The present invention also provides a method of producing a plant containing reduced levels of a plant sucrose pathway enzyme comprising: (A) transforming the plant with a functional nucleic acid molecule, wherein the functional nucleic acid molecule comprises a promoter region, wherein the promoter region is linked to a structural region, wherein the structural region comprises a nucleic acid molecule having a nucleic acid sequence selected from the group consisting of a nucleic acid molecule that encodes a maize or a soybean triose phosphate isomerase enzyme or fragment thereof, a nucleic acid molecule that encodes a maize or a soybean fructose 1,6-bisphosphate aldolase enzyme or fragment thereof, a nucleic acid molecule that encodes a maize or a soybean fructose 1,6-bisphosphate enzyme or fragment thereof, a nucleic acid molecule that encodes a maize or a soybean fructose 6-phosphate 2-kinase enzyme or fragment thereof, a nucleic acid molecule that encodes a maize or a soybean phosphoglucoisomerase enzyme or fragment thereof, a nucleic acid molecule that encodes a maize or a soybean vacuolar $H^+$ translocating-pyrophosphatase enzyme or fragment thereof, a nucleic acid molecule that encodes a maize or a soybean pyrophosphate-dependent fructose-6-phosphate phosphotransferase enzyme or fragment thereof a nucleic acid molecule that encodes a maize or a soybean invertase enzyme or fragment thereof, a nucleic acid molecule that encodes a maize or a soybean sucrose synthase enzyme or fragment thereof a nucleic acid molecule that encodes a maize or a soybean hexokinase enzyme or fragment thereof, a nucleic acid molecule that encodes a maize or a soybean fructokinase enzyme or fragment thereof, a nucleic acid molecule that encodes a maize or a soybean NDP-kinase enzyme or fragment thereof, a nucleic acid molecule that encodes a maize or a soybean glucose-6-phosphate 1-dehydrogenase enzyme or fragment thereof, a nucleic acid molecule that encodes a maize or a soybean phosphoglucomutase enzyme or fragment thereof and a nucleic acid molecule that encodes a maize or a soybean UDP-glucose pyrophophorylase enzyme or fragment thereof, wherein the structural region is linked to a 3' non-translated sequence that functions in the plant to cause termination of transcription and addition of polyadenylated ribonucleotides to a 3' end of a mRNA molecule; and wherein the functional nucleic acid molecule results in co-suppression of the plant sucrose pathway enzyme; and (B) growing the transformed plant.

The present invention also provides a method for reducing expression of a plant sucrose pathway enzyme in a plant comprising: (A) transforming the plant with a nucleic acid molecule, the nucleic acid molecule having an exogenous promoter region which functions in a plant cell to cause the production of a mRNA molecule, wherein the exogenous promoter region is linked to a transcribed nucleic acid molecule having a transcribed strand and a non-transcribed strand, wherein the transcribed strand is complementary to a nucleic acid molecule having a nucleic acid sequence selected from the group consisting of SEQ ID NO: 1 through SEQ ID NO: 2814 or complements thereof or fragments of either and the transcribed strand is complementary to an endogenous mRNA molecule; and wherein the transcribed nucleic acid molecule is linked to a 3' non-translated sequence that functions in the plant cell to cause termination of transcription and addition of polyadenylated ribonucleotides to a 3' end of a mRNA molecule; and (B) growing the transformed plant.

The present invention also provides a method for reducing expression of a plant sucrose pathway enzyme in a plant comprising: (A) transforming the plant with a nucleic acid molecule, the nucleic acid molecule having an exogenous promoter region which functions in a plant cell to cause the production of a mRNA molecule, wherein the exogenous promoter region is linked to a transcribed nucleic acid molecule having a transcribed strand and a non-transcribed strand, wherein a transcribed mRNA of the transcribed strand is complementary to a nucleic acid molecule selected from the group consisting of an endogenous mRNA molecule that encodes a maize or a soybean triose phosphate isomerase enzyme or fragment thereof, an endogenous mRNA molecule that encodes a maize or a soybean fructose 1,6-bisphosphate aldolase enzyme or fragment thereof, an endogenous mRNA molecule that encodes a maize or a soybean fructose 1,6- bisphosphate enzyme or fragment thereof, an endogenous mRNA molecule that encodes a maize or a soybean fructose 6-phosphate 2-kinase enzyme or fragment thereof, an endogenous mRNA molecule that encodes a maize or a soybean phosphoglucoisomerase enzyme or fragment thereof, an endogenous mRNA molecule that encodes a maize or a soybean vacuolar H$^+$ translocating-pyrophosphatase enzyme or fragment thereof, an endogenous mRNA molecule that encodes a maize or a soybean pyrophosphate-dependent fructose-6-phosphate phosphotransferase enzyme or fragment thereof, an endogenous mRNA molecule that encodes a maize or a soybean invertase enzyme or fragment thereof, an endogenous mRNA molecule that encodes a maize or a soybean sucrose synthase enzyme or fragment thereof, an endogenous mRNA molecule that encodes a maize or a soybean hexokinase enzyme or fragment thereof, an endogenous mRNA molecule that encodes a maize or a soybean fructokinase enzyme or fragment thereof, an endogenous mRNA molecule that encodes a maize or a soybean NDP-kinase enzyme or fragment thereof, an endogenous mRNA molecule that encodes a maize or a soybean glucose-6-phosphate 1-dehydrogenase enzyme or fragment thereof, an endogenous mRNA molecule that encodes a maize or a soybean phosphoglucomutase enzyme or fragment thereof and an endogenous mRNA molecule that encodes a maize or a soybean UDP-glucose pyrophophorylase enzyme or fragment thereof, and wherein the transcribed nucleic acid molecule is linked to a 3' non-translated sequence that functions in the plant cell to cause termination of transcription and addition of polyadenylated ribonucleotides to a 3' end of a mRNA molecule; and (B) growing the transformed plant.

The present invention also provides a method of determining an association between a polymorphism and a plant trait comprising: (A) hybridizing a nucleic acid molecule specific for the polymorphism to genetic material of a plant, wherein the nucleic acid molecule has a nucleic acid sequence selected from the group consisting of SEQ ID NO: 1 through SEQ ID NO: 2814 or complements thereof or fragment of either; and (B) calculating the degree of association between the polymorphism and the plant trait.

The present invention also provides a method of determining an association between a polymorphism and a plant trait comprising: (A) hybridizing a nucleic acid molecule specific for the polymorphism to genetic material of a plant, wherein the nucleic acid molecule is selected from the group consisting of a nucleic acid molecule that encodes a maize or a soybean triose phosphate isomerase enzyme or complement thereof or fragment of either, a nucleic acid molecule that encodes a maize or a soybean fructose 1,6-bisphosphate aldolase enzyme or complement thereof or fragment of either, a nucleic acid molecule that encodes a maize or a soybean fructose 1,6-bisphosphate enzyme or complement thereof or fragment of either, a nucleic acid molecule that encodes a maize or a soybean fructose 6-phosphate 2-kinase enzyme or complement thereof or fragment of either, a nucleic acid molecule that encodes a maize or a soybean phosphoglucoisomerase enzyme or complement thereof or fragment of either, a nucleic acid molecule that encodes a maize or a soybean vacuolar H$^+$ translocating-pyrophosphatase enzyme or complement thereof or fragment of either, a nucleic acid molecule that encodes a maize or a soybean pyrophosphate-dependent fructose-6-phosphate phosphotransferase enzyme or complement thereof or fragment of either, a nucleic acid molecule that encodes a maize or a soybean invertase enzyme or complement thereof or fragment of either, a nucleic acid molecule that encodes a maize or a soybean sucrose synthase enzyme or complement thereof or fragment of either, a nucleic acid molecule that encodes a maize or a soybean hexokinase enzyme or complement thereof or fragment of either, a nucleic acid molecule that encodes a maize or a soybean fructokinase enzyme or complement thereof or fragment of either f, a nucleic acid molecule that encodes a maize or a soybean NDP-kinase enzyme or complement thereof or fragment of either, a nucleic acid molecule that encodes a maize or a soybean glucose-6-phosphate 1-dehydrogenase enzyme or complement thereof or fragment of either, a nucleic acid molecule that encodes a maize or a soybean phosphoglucomutase enzyme or complement thereof or fragment of either and a nucleic acid molecule that encodes a maize or a soybean UDP-glucose pyrophophorylase enzyme or complement thereof or fragment of either and (B) calculating the degree of association between the polymorphism and the plant trait.

The present invention also provides a method of isolating a nucleic acid that encodes a plant sucrose pathway enzyme or fragment thereof comprising: (A) incubating under conditions permitting nucleic acid hybridization, a first nucleic acid molecule comprising a nucleic acid sequence selected from the group consisting of SEQ ID NO: 1 through SEQ ID NO: 2814 or complements thereof or fragment of either with a complementary second nucleic acid molecule obtained from a plant cell or plant tissue; (B) permitting hybridization between the first nucleic acid molecule and the second nucleic acid molecule obtained from the plant cell or plant tissue; and (C) isolating the second nucleic acid molecule.

The present invention also provides a method of isolating a nucleic acid molecule that encodes a plant sucrose pathway enzyme or fragment thereof comprising: (A) incubating under conditions permitting nucleic acid hybridization, a first nucleic acid molecule selected from the group consisting of a nucleic acid molecule that encodes a maize or a soybean triose phosphate isomerase enzyme or complement thereof or fragment of either, a nucleic acid molecule that encodes a maize or a soybean fructose 1,6-bisphosphate aldolase enzyme or complement thereof or fragment of either, a nucleic acid molecule that encodes a maize or a soybean fructose 1,6-bisphosphate enzyme or complement thereof or fragment of either, a nucleic acid molecule that encodes a maize or a soybean fructose 6-phosphate 2-kinase enzyme or complement thereof or fragment of either, a nucleic acid molecule that encodes a maize or a soybean phosphoglucoisomerase enzyme or complement thereof or fragment of either, a nucleic acid molecule that encodes a maize or a soybean vacuolar H$^+$ translocating-pyrophosphatase enzyme or complement thereof or fragment of either, a nucleic acid molecule that encodes a maize or a soybean pyrophosphate-dependent fructose-6-phosphate phosphotransferase enzyme or complement thereof or fragment of either, a nucleic acid molecule that encodes a maize or a soybean invertase enzyme or complement thereof or fragment of either, a nucleic acid molecule that encodes a maize or a soybean sucrose synthase enzyme or complement thereof or fragment of either, a nucleic acid molecule that encodes a maize or a soybean hexokinase enzyme or complement thereof or fragment of either, a nucleic acid molecule that encodes a maize or a soybean fructokinase enzyme or complement thereof or fragment of either f, a nucleic acid molecule that encodes a maize or a soybean NDP-kinase enzyme or complement thereof or fragment of either, a nucleic acid molecule that encodes a maize or a soybean glucose-6-phosphate 1-dehydrogenase enzyme or complement thereof or fragment of either, a nucleic acid molecule that encodes a maize or a soybean phosphoglucomutase enzyme or complement thereof or fragment of either and a nucleic acid molecule that encodes a maize or a soybean UDP-glucose pyrophophorylase enzyme or complement thereof or fragment of either, with a complementary second nucleic acid molecule obtained from a plant cell or plant tissue; (B) permitting hybridization between the plant sucrose pathway nucleic acid molecule and the complementary nucleic acid molecule obtained from the plant cell or plant tissue; and (C) isolating the second nucleic acid molecule.

DETAILED DESCRIPTION OF THE INVENTION

Definitions and Agents of the Present Invention

Definitions:

As used herein, a sucrose pathway enzyme is any enzyme that is associated with the synthesis or degradation of sucrose.

As used herein, a sucrose synthesis enzyme is any enzyme that is associated with the synthesis of sucrose.

As used herein, a sucrose degradation enzyme is any enzyme that is associated with the degradation of sucrose.

As used herein, triose phosphate isomerase is any enzyme that maintains at equilibrium the pool of triose phosphates, dihydroxyacetone phosphate ("DHAP"), and glyceraldehyde-3-phosphate ("GAP") within the cytoplasm.

As used herein, fructose 1,6-bisphosphate aldolase is any enzyme that catalyzes an aldol condensation of DHAP and GAP to form fructose 1,6-bisphosphate ("F1,6BP").

As used herein, fructose-1,6-bisphosphatase ("FBPase") is any enzyme that catalyzes the cleavage of phosphate from the C1 carbon of fructose-1,6-bisphosphate to form fructose-6-phosphate ("F6P").

As used herein, fructose 6-phosphate 2-kinase is any enzyme that controls the concentration of fructose 2,6-bisphosphate.

As used herein, phosphoglucoisomerase is any enzyme that maintains glucose-6-phosphate ("G6P") and glucose-1-phosphate ("G1P") in equilibrium with the F6P pool.

As used herein, vacuolar $H^+$ translocating-pyrophosphatase is any enzyme that utilizes pyrophosphate to sustain a proton gradient formed within the vacuolar membrane.

As used herein, pyrophosphate-dependent fructose-6-phosphate phosphotransferase is any enzyme that catalyzes the reversible production of F1,6BP and Pi from F6P and PPi.

As used herein, invertase is any enzyme that irreversibly cleaves sucrose into glucose and fructose.

As used herein, sucrose synthase is any enzyme that carries out the kinetically reversible transglycosylation of sucrose and UDP into fructose and UDPG.

As used herein, hexokinase is any enzyme that can phosphorylate either glucose or fructose.

As used herein, fructokinase is any enzyme that typically has a specific affinity for fructose.

As used herein, NDP-kinase is any enzyme that can maintain UDP levels for sucrose synthase reactions, even in the case of an ATP-specific fructokinase.

As used herein, glucose-6-phosphate 1-dehydrogenase is any enzyme that allows G6P resulting from hexose kinase activity to enter the pentose phosphate pathway.

As used herein, UDP-glucose dehydrogenase is any enzyme that allows UDPG formed by sucrose synthase to be utilized directly for cellulose or callose biosynthesis.

As used herein, phosphoglucomutase is any enzyme that is ubiquitous and reversible with commitments of G6P to either F6P or G1P resulting from fluxes in metabolites further along each pathway.

Agents (a) Nucleic Acid Molecules

Agents of the present invention include plant nucleic acid molecules and more preferably include maize and soybean nucleic acid molecules and more preferably include nucleic acid molecules of the maize genotypes B73 (Illinois Foundation Seeds, Champaign, Ill. U.S.A.), B73 x Mo17 (Illinois Foundation Seeds, Champaign, Ill. U.S.A.), DK604 (Dekalb Genetics, Dekalb, Ill. U.S.A.), H99 (Illinois Foundation Seeds, Champaign, Ill. U.S.A.), RX601 (Asgrow Seed Company, Des Moines, Iowa), Mo17 (Illinois Foundation Seeds, Champaign, Ill. U.S.A.), and soybean types Asgrow 3244 (Asgrow Seed Company, Des Moines, Iowa), C1944 (United States Department of Agriculture (USDA) Soybean Germplasm Collection, Urbana, Ill. U.S.A.), Cristalina (USDA Soybean Germplasm Collection, Urbana, Ill. U.S.A.), FT108 (Monsoy, Brazil), Hartwig (USDA Soybean Germplasm Collection, Urbana, Ill. U.S.A.), BW211S Null (Tohoku University, Morioka, Japan), PI507354 (USDA Soybean Germplasm Collection, Urbana, Ill. U.S.A.), Asgrow A4922 (Asgrow Seed Company, Des Moines, Iowa U.S.A.), PI227687 (USDA Soybean Germplasm Collection, Urbana, Ill. U.S.A.), PI229358 (USDA Soybean Germplasm Collection, Urbana, Ill. U.S.A.) and Asgrow A3237 (Asgrow Seed Company, Des Moines, Iowa U.S.A.).

A subset of the nucleic acid molecules of the present invention includes nucleic acid molecules that are marker molecules. Another subset of the nucleic acid molecules of the present invention include nucleic acid molecules that encode a protein or fragment thereof. Another subset of the nucleic acid molecules of the present invention are EST molecules.

Fragment nucleic acid molecules may encode significant portion(s) of, or indeed most of, these nucleic acid molecules. Alternatively, the fragments may comprise smaller oligonucleotides (having from about 15 to about 250 nucleotide residues and more preferably, about 15 to about 30 nucleotide residues).

As used herein, an agent, be it a naturally occurring molecule or otherwise may be "substantially purified," if desired, such that one or more molecules that is or may be present in a naturally occurring preparation containing that molecule will have been removed or will be present at a lower concentration than that at which it would normally be found.

The agents of the present invention will preferably be "biologically active" with respect to either a structural attribute, such as the capacity of a nucleic acid to hybridize to another nucleic acid molecule, or the ability of a protein to be bound by an antibody (or to compete with another molecule for such binding). Alternatively, such an attribute may be catalytic and thus involve the capacity of the agent to mediate a chemical reaction or response.

The agents of the present invention may also be recombinant. As used herein, the term recombinant means any agent (e.g. DNA, peptide etc.), that is, or results, however indirect, from human manipulation of a nucleic acid molecule.

It is understood that the agents of the present invention may be labeled with reagents that facilitate detection of the agent (e.g. fluorescent labels, Prober et al., Science 238:336-340 (1987); Albarella et al., EP 144914; chemical labels, Sheldon et al., U.S. Pat. No. 4,582,789; Albarella et al., U.S. Pat. No. 4,563,417; modified bases, Miyoshi et al., EP 119448, all of which are hereby incorporated by reference in their entirety).

It is further understood, that the present invention provides recombinant bacterial, mammalian, microbial, insect, fungal and plant cells and viral constructs comprising the agents of the present invention (See, for example, Uses of the Agents of the Invention, Section (a) Plant Constructs and Plant Transformants; Section (b) Fungal Constructs and Fungal Transformants; Section (c) Mammalian Constructs and Transformed Mammalian Cells; Section (d) Insect Constructs and Transformed Insect Cells; and Section (e) Bacterial Constructs and Transformed Bacterial Cells).

Nucleic acid molecules or fragments thereof of the present invention are capable of specifically hybridizing to other nucleic acid molecules under certain circumstances. As used herein, two nucleic acid molecules are said to be capable of specifically hybridizing to one another if the two molecules are capable of forming an anti-parallel, double-stranded nucleic acid structure. A nucleic acid molecule is said to be the "complement" of another nucleic acid molecule if they exhibit complete complementarity. As used herein, molecules are said to exhibit "complete complementarity" when every nucleotide of one of the molecules is complementary to a nucleotide of the other. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Conventional stringency conditions are described by Sambrook et al., *Molecular Cloning*, A Laboratory Manual, 2nd Ed., Cold Spring Harbor Press, Cold Spring Harbor, N.Y. (1989) and by Haymes et al., *Nucleic Acid Hybridization, A Practical Approach*, IRL Press, Washington, D.C. (1985), the entirety of which is herein incorporated by reference. Departures from complete complementarity are therefore permissible, as long as such departures do not completely preclude the capacity of the molecules to form a double-stranded structure. Thus, in order for a nucleic acid molecule to serve as a primer or probe it need only be sufficiently complementary in sequence to be able to form a stable double-stranded structure under the particular solvent and salt concentrations employed.

Appropriate stringency conditions which promote DNA hybridization, for example, 6.0×sodium chloride/sodium citrate (SSC) at about 45° C., followed by a wash of 2.0×SSC at 50° C., are known to those skilled in the art or can be found in *Current Protocols in Molecular Biology*, John Wiley & Sons, N.Y. (1989), 6.3.1-6.3.6. For example, the salt concentration in the wash step can be selected from a low stringency of about 2.0×SSC at 50° C. to a high stringency of about 0.2× SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed.

In a preferred embodiment, a nucleic acid of the present invention will specifically hybridize to one or more of the nucleic acid molecules set forth in SEQ ID NO: 1 through SEQ ID NO: 2814 or complements thereof under moderately stringent conditions, for example at about 2.0×SSC and about 65° C.

In a particularly preferred embodiment, a nucleic acid of the present invention will include those nucleic acid molecules that specifically hybridize to one or more of the nucleic acid molecules set forth in SEQ ID NO: 1 through SEQ ID NO: 2814 or complements thereof under high stringency conditions such as 0.2×SSC and about 65° C.

In one aspect of the present invention, the nucleic acid molecules of the present invention have one or more of the nucleic acid sequences set forth in SEQ ID NO: 1 through SEQ ID NO: 2814 or complements thereof. In another aspect of the present invention, one or more of the nucleic acid molecules of the present invention share between 100% and 90% sequence identity with one or more of the nucleic acid sequences set forth in SEQ ID NO: 1 through SEQ ID NO: 2814 or complements thereof. In a further aspect of the present invention, one or more of the nucleic acid molecules of the present invention share between 100% and 95% sequence identity with one or more of the nucleic acid sequences set forth in SEQ ID NO: 1 through SEQ ID NO: 2814 or complements thereof. In a more preferred aspect of the present invention, one or more of the nucleic acid molecules of the present invention share between 100% and 98% sequence identity with one or more of the nucleic acid sequences set forth in SEQ ID NO: 1 through SEQ ID NO: 2814 or complements thereof. In an even more preferred aspect of the present invention, one or more of the nucleic acid molecules of the present invention share between 100% and 99% sequence identity with one or more of the sequences set forth in SEQ ID NO: 1 through SEQ ID NO: 2814 or complements thereof.

In a further more preferred aspect of the present invention, one or more of the nucleic acid molecules of the present invention exhibit 100% sequence identity with a nucleic acid molecule present within MONN01, SATMON001 through SATMON031, SATMON033, SATMON034, SATMON~001, SATMONN01, SATMONN04 through SATMONN006, CMz029 through CMz031, CMz033, CMz035 through CMz037, CMz039 through CMz042, CMz044 through CMz045, CMz047 through CMz050, SOYMON001 through SOYMON038, Soy51 through Soy56, Soy58 through Soy62, Soy65 through Soy66, Soy 68 through Soy73 and Soy76 through Soy77, Lib9, Lib22 through Lib25, Lib35, Lib80 through Lib81, Lib 144, Lib146, Lib147, Lib190, Lib3032 through Lib3036 and Lib3099 (Monsanto Company, St. Louis, Mo. U.S.A.).

(i) Nucleic Acid Molecules Encoding Proteins or Fragments Thereof

Nucleic acid molecules of the present invention can comprise sequences that encode a sucrose pathway protein or fragment thereof. Such proteins or fragments thereof include homologues of known proteins in other organisms.

In a preferred embodiment of the present invention, a maize or a soybean protein or fragment thereof of the present invention is a homologue of another plant protein. In another preferred embodiment of the present invention, a maize or a soybean protein or fragment thereof of the present invention is a homologue of a fungal protein. In another preferred embodiment of the present invention, a maize or a soybean protein of the present invention is a homologue of mammalian protein. In another preferred embodiment of the present invention, a maize or a soybean protein or fragment thereof of the present invention is a homologue of a bacterial protein. In another preferred embodiment of the present invention, a soybean protein or fragment thereof of the present invention is a homologue of a maize protein. In another preferred embodiment of the present invention, a maize protein homologue or fragment thereof of the present invention is a homologue of a soybean protein.

In a preferred embodiment of the present invention, the nucleic molecule of the present invention encodes a maize or a soybean protein or fragment thereof where a maize or a soybean protein exhibits a BLAST probability score of greater than 1E-12, preferably a BLAST probability score of between about 1E-30 and about 1E-12, even more preferably a BLAST probability score of greater than 1E-30 with its homologue.

In another preferred embodiment of the present invention, the nucleic acid molecule encoding a maize or a soybean protein or fragment thereof exhibits a % identity with its homologue of between about 25% and about 40%, more preferably of between about 40 and about 70%, even more preferably of between about 70% and about 90% and even more preferably between about 90% and 99%. In another preferred embodiment, of the present invention, a maize or a soybean protein or fragments thereof exhibits a % identity with its homologue of 100%.

In a preferred embodiment of the present invention, the nucleic molecule of the present invention encodes a maize or a soybean protein or fragment thereof where a maize or a soybean protein exhibits a BLAST score of greater than 120, preferably a BLAST score of between about 1450 and about 120, even more preferably a BLAST score of greater than 1450 with its homologue.

Nucleic acid molecules of the present invention also include non-maize, non-soybean homologues. Preferred non-maize and soybean homologues are selected from the group consisting of alfalfa, *Arabidopsis*, barley, *Brassica*, broccoli, cabbage, citrus, cotton, garlic, oat, oilseed rape, onion, canola, flax, an ornamental plant, pea, peanut, pepper, potato, rice, rye, sorghum, strawberry, sugarcane, sugarbeet, tomato, wheat, poplar, pine, fir, eucalyptus, apple, lettuce, lentils, grape, banana, tea, turf grasses, sunflower, oil palm and *Phaseolus*.

In a preferred embodiment, nucleic acid molecules having SEQ ID NO: 1 through SEQ ID NO: 2814 or complements and fragments of either can be utilized to obtain such homologues.

The degeneracy of the genetic code, which allows different nucleic acid sequences to code for the same protein or peptide, is known in the literature. (U.S. Pat. No. 4,757,006, the entirety of which is herein incorporated by reference).

In an aspect of the present invention, one or more of the nucleic acid molecules of the present invention differ in nucleic acid sequence from those encoding a maize or a soybean protein or fragment thereof in SEQ ID NO: 1 through SEQ ID NO: 2814 due to the degeneracy in the genetic code in that they encode the same protein but differ in nucleic acid sequence.

In another further aspect of the present invention, one or more of the nucleic acid molecules of the present invention differ in nucleic acid sequence from those encoding a maize or a soybean protein or fragment thereof in SEQ ID NO: 1 through SEQ ID NO: 2814 due to fact that the different nucleic acid sequence encodes a protein having one or more conservative amino acid residue. Examples of conservative substitutions are set forth in Table 1. It is understood that codons capable of coding for such conservative substitutions are known in the art.

TABLE 1

| Original Residue | Conservative Substitutions |
| --- | --- |
| Ala | Ser |
| Arg | Lys |
| Asn | Gln; His |
| Asp | Glu |
| Cys | Ser; Ala |
| Gln | Asn |
| Glu | Asp |
| Gly | Pro |
| His | Asn; Gln |
| Ile | Leu; Val |
| Leu | Ile; Val |
| Lys | Arg; Gln; Glu |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

In a further aspect of the present invention, one or more of the nucleic acid molecules of the present invention differ in nucleic acid sequence from those encoding a maize or a soybean protein or fragment thereof set forth in SEQ ID NO: 1 through SEQ ID NO: 2814 or fragment thereof due to the fact that one or more codons encoding an amino acid has been substituted for a codon that encodes a nonessential substitution of the amino acid originally encoded.

Agents of the present invention include nucleic acid molecules that encode a maize or a soybean sucrose pathway protein or fragment thereof and particularly substantially purified nucleic acid molecules selected from the group consisting of a nucleic acid molecule that encodes a maize or a soybean triose phosphate isomerase protein or fragment thereof, a nucleic acid molecule that encodes a maize or a soybean fructose 1,6-bisphosphate aldolase protein or fragment thereof, a nucleic acid molecule that encodes a maize or a soybean fructose 1,6-bisphosphate protein or fragment thereof, a nucleic acid molecule that encodes a maize or a soybean fructose 6-phosphate 2-kinase protein or fragment thereof, a nucleic acid molecule that encodes a maize or a soybean phosphoglucoisomerase protein or fragment thereof, a nucleic acid molecule that encodes a maize or a soybean vacuolar $H^+$ translocating-pyrophosphatase protein or fragment thereof, a nucleic acid molecule that encodes a maize or a soybean pyrophosphate-dependent fructose-6-phosphate phosphotransferase protein or fragment thereof, a nucleic acid molecule that encodes a maize or a soybean invertase protein or fragment thereof, a nucleic acid molecule that encodes a maize or a soybean sucrose synthase protein or fragment thereof, a nucleic acid molecule that encodes a maize or a soybean hexokinase protein or fragment thereof, a nucleic acid molecule that encodes a maize or a soybean fructokinase protein or fragment thereof, a nucleic acid molecule that encodes a maize or a soybean NDP-kinase protein or fragment thereof, a nucleic acid molecule that encodes a maize or a soybean glucose-6-phosphate 1-dehydrogenase protein or fragment thereof, a nucleic acid molecule that encodes a maize or a soybean phosphoglucomutase protein or fragment thereof and a nucleic acid molecule that encodes a maize or a soybean UDP-glucose pyrophophorylase protein or fragment thereof.

Non-limiting examples of such nucleic acid molecules of the present invention are nucleic acid molecules comprising: SEQ ID NO: 1 through SEQ ID NO: 2814 or fragment thereof that encode for a sucrose pathway protein or fragment thereof, SEQ ID NO: 1 through SEQ ID NO: 206 and SEQ ID NO: 1538 through SEQ ID NO: 1707 or fragment thereof that encode for a triose phosphate isomerase protein or fragment thereof, SEQ ID NO: 207 through SEQ ID NO: 232 and SEQ ID NO: 1708 through SEQ ID NO: 2113 or fragment thereof that encode for a fructose 1,6-bisphosphate aldolase protein or fragment thereof, SEQ ID NO: 233 through SEQ ID NO: 258 and SEQ ID NO: 2114 through SEQ ID NO: 2162 or fragment thereof that encode for a fructose 1,6-bisphosphate protein or fragment thereof, SEQ ID NO: 259 through SEQ ID NO: 275 and SEQ ID NO: 2163 through SEQ ID NO: 2166 or fragment thereof that encode for a fructose 6-phosphate 2-kinase protein or fragment thereof, SEQ ID NO: 276 through SEQ ID NO: 340 and SEQ ID NO: 2167 through SEQ ID NO: 2182 or fragment thereof that encode for a phosphoglucoisomerase protein or fragment thereof, SEQ ID NO: 341 through SEQ ID NO: 497 and SEQ ID NO: 2183 through SEQ ID NO: 2241 or fragment thereof that encode for a vacuolar $H^+$ translocating-pyrophosphatase protein or fragment thereof, SEQ ID NO: 498 through SEQ ID NO: 507 and SEQ ID NO: 2442 or fragment thereof that encode for a pyrophosphate-dependent fructose-6-phosphate phosphotransferase protein or fragment thereof, SEQ ID NO: 508 through SEQ ID NO: 510 and SEQ ID NO: 2243 through SEQ ID NO: 2254 or fragment thereof that encode for an invertase protein or fragment thereof, SEQ ID NO: 511 through SEQ ID NO: 1086 and SEQ ID NO: 2255 through SEQ ID NO: 2590 or fragment thereof that encode for a sucrose synthase protein or fragment thereof, SEQ ID NO: 1087 through SEQ ID NO: 1135 and SEQ ID NO: 2591 through SEQ ID NO: 2634 or fragment thereof that encode for a hexokinase protein or fragment thereof, SEQ ID NO: 1136 through SEQ ID NO: 1215 and SEQ ID NO: 2635 through SEQ ID NO: 2678 or fragment thereof that encode for a fructokinase protein or fragment thereof, SEQ ID NO: 1216 through SEQ ID NO: 1251 and SEQ ID NO: 2679 through SEQ ID NO: 2681 or fragment thereof that encode for a NDP-kinase protein or fragment thereof, SEQ ID NO: 1252 through SEQ ID NO: 1254 and SEQ ID NO: 2682 through SEQ ID NO: 2689 or fragment thereof that encode for a glucose-6-phosphate 1-dehydrogenase protein or fragment thereof, SEQ ID NO: 1255 through SEQ ID NO: 1360 and SEQ ID NO: 2690 through SEQ ID NO: 2740 or fragment thereof that encode for a phosphoglucomutase protein or fragment thereof and SEQ ID NO: 1361 through SEQ ID NO: 1537 and SEQ ID NO: 2741 through SEQ ID NO: 2814 or fragment thereof that encode for an UDP-glucose pyrophophorylase protein or fragment thereof.

A nucleic acid molecule of the present invention can also encode a homologue of a maize or a soybean triose phosphate isomerase or fragment thereof, a maize or a soybean fructose 1,6-bisphosphate aldolase or fragment thereof, a maize or a soybean fructose 1,6-bisphosphate or fragment thereof, a maize or a soybean fructose 6-phosphate 2-kinase or fragment thereof, a maize or a soybean phosphoglucoisomerase or fragment thereof, a maize or a soybean vacuolar $H^+$ translocating-pyrophosphatase or fragment thereof, a maize or a soybean pyrophosphate-dependent fructose-6-phosphate phosphotransferase or fragment thereof, a maize or a soybean invertase or fragment thereof, a maize or a soybean sucrose synthase or fragment thereof, a maize or a soybean hexokinase or fragment thereof, a maize or a soybean fructokinase or fragment thereof, a maize or a soybean NDP-kinase or fragment thereof, a maize or a soybean glucose-6-phosphate 1-dehydrogenase or fragment thereof, a maize or a soybean phosphoglucomutase or fragment thereof and a maize or a soybean UDP-glucose pyrophophorylase or fragment thereof. As used herein a homologue protein molecule or fragment thereof is a counterpart protein molecule or fragment thereof in a second species (e.g., maize triose phosphate isomerase protein is a homologue of soybean triose phosphate isomerase protein).

(ii) Nucleic Acid Molecule Markers and Probes

One aspect of the present invention concerns markers that include nucleic acid molecules SEQ ID NO: 1 through SEQ ID NO: 2814 or complements thereof or fragments of either that can act as markers or other nucleic acid molecules of the present invention that can act as markers. Genetic markers of the present invention include "dominant" or "codominant" markers "Codominant markers" reveal the presence of two or more alleles (two per diploid individual) at a locus. "Dominant markers" reveal the presence of only a single allele per locus. The presence of the dominant marker phenotype (e.g., a band of DNA) is an indication that one allele is present in either the homozygous or heterozygous condition. The absence of the dominant marker phenotype (e.g. absence of a DNA band) is merely evidence that "some other" undefined allele is present. In the case of populations where individuals are predominantly homozygous and loci are predominately dimorphic, dominant and codominant markers can be equally valuable. As populations become more heterozygous and multi-allelic, codominant markers often become more informative of the genotype than dominant markers. Marker molecules can be, for example, capable of detecting polymorphisms such as single nucleotide polymorphisms (SNPs).

SNPs are single base changes in genomic DNA sequence. They occur at greater frequency and are spaced with a greater uniformly throughout a genome than other reported forms of polymorphism. The greater frequency and uniformity of SNPs means that there is greater probability that such a polymorphism will be found near or in a genetic locus of interest than would be the case for other polymorphisms. SNPs are located in protein-coding regions and noncoding regions of a genome. Some of these SNPs may result in defective or variant protein expression (e.g., as a result of mutations or defective splicing). Analysis (genotyping) of characterized SNPs can require only a plus/minus assay rather than a lengthy measurement, permitting easier automation.

SNPs can be characterized using any of a variety of methods. Such methods include the direct or indirect sequencing of the site, the use of restriction enzymes (Botstein et al., *Am. J. Hum. Genet.* 32:314-331 (1980), the entirety of which is herein incorporated reference; Konieczny and Ausubel, *Plant J.* 4:403-410 (1993), the entirety of which is herein incorporated by reference), enzymatic and chemical mismatch assays (Myers et al., *Nature* 313:495-498 (1985), the entirety of which is herein incorporated by reference), allele-specific PCR (Newton et al., *Nucl. Acids Res.* 17:2503-2516 (1989), the entirety of which is herein incorporated by reference; Wu et al., *Proc. Natl. Acad. Sci.* (U.S.A.) 86:2757-2760 (1989), the entirety of which is herein incorporated by reference), ligase chain reaction (Barany, *Proc. Natl. Acad. Sci.* (U.S.A.) 88:189-193 (1991), the entirety of which is herein incorporated by reference), single-strand conformation polymorphism analysis (Labrune et al., *Am. J. Hum. Genet.* 48: 1115-1120 (1991), the entirety of which is herein incorporated by reference), primer-directed nucleotide incorporation assays (Kuppuswami et al., *Proc. Natl. Acad. Sci. USA* 88:1143-1147 (1991), the entirety of which is herein incorporated by reference), dideoxy fingerprinting (Sarkar et al., *Genomics* 13:441-443 (1992), the entirety of which is herein incorporated by reference), solid-phase ELISA-based oligonucleotide ligation assays (Nikiforov et al., *Nucl. Acids Res.* 22:4167-4175 (1994), the entirety of which is herein incorporated by reference), oligonucleotide fluorescence-quenching assays (Livak et al., *PCR Methods Appl.* 4:357-362 (1995), the entirety of which is herein incorporated by reference), 5'-nuclease allele-specific hybridization TaqMan assay (Livak et al., *Nature Genet.* 9:341-342 (1995), the entirety of which is herein incorporated by reference), template-directed dye-terminator incorporation (TDI) assay (Chen and Kwok, *Nucl. Acids Res.* 25:347-353 (1997), the entirety of which is herein incorporated by reference), allele-specific molecular beacon assay (Tyagi et al., *Nature Biotech.* 16: 49-53 (1998), the entirety of which is herein incorporated by reference), PinPoint assay (Haff and Smirnov, *Genome Res.* 7: 378-388 (1997), the entirety of which is herein incorporated by reference) and dCAPS analysis (Neff et al., *Plant J.* 14:387-392 (1998), the entirety of which is herein incorporated by reference).

Additional markers, such as AFLP markers, RFLP markers and RAPD markers, can be utilized (Walton, *Seed World* 22-29 (July, 1993), the entirety of which is herein incorporated by reference; Burow and Blake, *Molecular Dissection of Complex Traits,* 13-29, Paterson (ed.), CRC Press, New York (1988), the entirety of which is herein incorporated by reference). DNA markers can be developed from nucleic acid molecules using restriction endonucleases, the PCR and/or DNA sequence information. RFLP markers result from single base changes or insertions/deletions. These codominant markers are highly abundant in plant genomes, have a medium level of polymorphism and are developed by a combination of restriction endonuclease digestion and Southern blotting hybridization. CAPS are similarly developed from restriction nuclease digestion but only of specific PCR products. These markers are also codominant, have a medium level of polymorphism and are highly abundant in the genome. The CAPS result from single base changes and insertions/deletions.

Another marker type, RAPDs, are developed from DNA amplification with random primers and result from single base changes and insertions/deletions in plant genomes. They are dominant markers with a medium level of polymorphisms and are highly abundant. AFLP markers require using the PCR on a subset of restriction fragments from extended adapter primers. These markers are both dominant and codominant are highly abundant in genomes and exhibit a medium level of polymorphism.

SSRs require DNA sequence information. These codominant markers result from repeat length changes, are highly polymorphic and do not exhibit as high a degree of abundance in the genome as CAPS, AFLPs and RAPDs SNPs also require DNA sequence information. These codominant markers result from single base substitutions. They are highly abundant and exhibit a medium of polymorphism (Rafalski et al., In: *Nonmammalian Genomic Analysis*, Birren and Lai (ed.), Academic Press, San Diego, Calif., pp. 75-134 (1996), the entirety of which is herein incorporated by reference). It is understood that a nucleic acid molecule of the present invention may be used as a marker.

A PCR probe is a nucleic acid molecule capable of initiating a polymerase activity while in a double-stranded structure to with another nucleic acid. Various methods for determining the structure of PCR probes and PCR techniques exist in the art. Computer generated searches using programs such as Primer3 available on the worldwide web at genome.wi.mit.edu/cgi-bin/primer/primer3.cgi), STSPipeline available on the worldwide web at genome.wi.mit.edu/cgi-bin/www-STS_Pipeline), or GeneUp (Pesole et al., *BioTechniques* 25:112-123 (1998) the entirety of which is herein incorporated by reference), for example, can be used to identify potential PCR primers.

It is understood that a fragment of one or more of the nucleic acid molecules of the present invention may be a probe and specifically a PCR probe.

(b) Protein and Peptide Molecules

A class of agents comprises one or more of the protein or fragments thereof or peptide molecules encoded by SEQ ID NO: 1 through SEQ ID NO: 2814 or one or more of the protein or fragment thereof and peptide molecules encoded by other nucleic acid agents of the present invention. As used herein, the term "protein molecule" or "peptide molecule" includes any molecule that comprises five or more amino acids. It is well known in the art that proteins may undergo modification, including post-translational modifications, such as, but not limited to, disulfide bond formation, glycosylation, phosphorylation, or oligomerization. Thus, as used herein, the term "protein molecule" or "peptide molecule" includes any protein molecule that is modified by any biological or non-biological process. The terms "amino acid" and "amino acids" refer to all naturally occurring L-amino acids. This definition is meant to include norleucine, ornithine, homocysteine and homoserine.

Non-limiting examples of the protein or fragment thereof of the present invention include a maize or a soybean sucrose pathway protein or fragment thereof; a maize or a soybean triose phosphate isomerase or fragment thereof, a maize or a soybean fructose 1,6-bisphosphate aldolase or fragment thereof, a maize or a soybean fructose 1,6-bisphosphate or fragment thereof, a maize or a soybean fructose 6-phosphate 2-kinase or fragment thereof, a maize or a soybean phosphoglucoisomerase or fragment thereof, a maize or a soybean vacuolar $H^+$ translocating-pyrophosphatase or fragment thereof, a maize or a soybean pyrophosphate-dependent fructose-6-phosphate phosphotransferase or fragment thereof, a maize or a soybean invertase or fragment thereof, a maize or a soybean sucrose synthase or fragment thereof, a maize or a soybean hexokinase or fragment thereof, a maize or a soybean fructokinase or fragment thereof, a maize or a soybean NDP-kinase or fragment thereof, a maize or a soybean glucose-6-phosphate 1-dehydrogenase or fragment thereof, a maize or a soybean phosphoglucomutase or fragment thereof and a maize or a soybean UDP-glucose pyrophophorylase or fragment thereof.

Non-limiting examples of the protein or fragment molecules of the present invention are a sucrose pathway protein or fragment thereof encoded by: SEQ ID NO: 1 through SEQ ID NO: 2814 or fragment thereof that encode for a sucrose pathway protein or fragment thereof, SEQ ID NO: 1 through SEQ ID NO: 206 and SEQ ID NO: 1538 through SEQ ID NO: 1707 or fragment thereof that encode for a triose phosphate isomerase protein or fragment thereof, SEQ ID NO: 207 through SEQ ID NO: 232 and SEQ ID NO: 1708 through SEQ ID NO: 2113 or fragment thereof that encode for a fructose 1,6-bisphosphate aldolase protein or fragment thereof, SEQ ID NO: 233 through SEQ ID NO: 258 and SEQ ID NO: 2114 through SEQ ID NO: 2162 or fragment thereof that encode for a fructose 1,6-bisphosphate protein or fragment thereof, SEQ ID NO: 259 through SEQ ID NO: 275 and SEQ ID NO: 2163 through SEQ ID NO: 2166 or fragment thereof that encode for a fructose 6-phosphate 2-kinase protein or fragment thereof, SEQ ID NO: 276 through SEQ ID NO: 340 and SEQ ID NO: 2167 through SEQ ID NO: 2182 or fragment thereof that encode for a phosphoglucoisomerase protein or fragment thereof, SEQ ID NO: 341 through SEQ ID NO: 497 and SEQ ID NO: 2183 through SEQ ID NO: 2241 or fragment thereof that encode for a vacuolar $H^+$ translocating-pyrophosphatase protein or fragment thereof, SEQ ID NO: 498 through SEQ ID NO: 507 and SEQ ID NO: 2442 or fragment thereof that encode for a pyrophosphate-dependent fructose-6-phosphate phosphotransferase protein or fragment thereof, SEQ ID NO: 508 through SEQ ID NO: 510 and SEQ ID NO: 2243 through SEQ ID NO: 2254 or fragment thereof that encode for an invertase protein or fragment thereof, SEQ ID NO: 511 through SEQ ID NO: 1086 and SEQ ID NO: 2255 through SEQ ID NO: 2590 or fragment thereof that encode for a sucrose synthase protein or fragment thereof, SEQ ID NO: 1087 through SEQ ID NO: 1135 and SEQ ID NO: 2591 through SEQ ID NO: 2634 or fragment thereof that encode for a hexokinase protein or fragment thereof, SEQ ID NO: 1136 through SEQ ID NO: 1215 and SEQ ID NO: 2635 through SEQ ID NO: 2678 or fragment thereof that encode for a fructokinase protein or fragment thereof, SEQ ID NO: 1216 through SEQ ID NO: 1251 and SEQ ID NO: 2679 through SEQ ID NO: 2681 or fragment thereof that encode for a NDP-kinase protein or fragment thereof, SEQ ID NO: 1252 through SEQ ID NO: 1254 and SEQ ID NO: 2682 through SEQ ID NO: 2689 or fragment thereof that encode for a glucose-6-phosphate 1-dehydrogenase protein or fragment thereof, SEQ ID NO: 1255 through SEQ ID NO: 1360 and SEQ ID NO: 2690 through SEQ ID NO: 2740 or fragment thereof that encode for a phosphoglucomutase protein or fragment thereof and SEQ ID NO: 1361 through SEQ ID NO: 1537 and SEQ ID NO: 2741 through SEQ ID NO: 2814 or fragment thereof that encode for an UDP-glucose pyrophophorylase protein or fragment thereof.

One or more of the protein or fragment of peptide molecules may be produced via chemical synthesis, or more preferably, by expressing in a suitable bacterial or eucaryotic host. Suitable methods for expression are described by Sambrook et al., (In: *Molecular Cloning, A Laboratory Manual*, 2nd Edition, Cold Spring Harbor Press, Cold Spring Harbor, N.Y. (1989)), or similar texts. For example, the protein may be expressed in, for example, Uses of the Agents of the Invention, Section (a) Plant Constructs and Plant Transformants; Section (b) Fungal Constructs and Fungal Transformants; Section (c) Mammalian Constructs and Transformed Mammalian Cells; Section (d) Insect Constructs and Transformed Insect Cells; and Section (e) Bacterial Constructs and Transformed Bacterial Cells.

A "protein fragment" is a peptide or polypeptide molecule whose amino acid sequence comprises a subset of the amino acid sequence of that protein. A protein or fragment thereof that comprises one or more additional peptide regions not derived from that protein is a "fusion" protein. Such molecules may be derivatized to contain carbohydrate or other moieties (such as keyhole limpet hemocyanin, etc.). Fusion protein or peptide molecules of the present invention are preferably produced via recombinant means.

Another class of agents comprise protein or peptide molecules or fragments or fusions thereof encoded by SEQ ID NO: 1 through SEQ ID NO: 2814 or complements thereof in which conservative, non-essential or non-relevant amino acid residues have been added, replaced or deleted. Computerized means for designing modifications in protein structure are known in the art (Dahiyat and Mayo, *Science* 278:82-87 (1997), the entirety of which is herein incorporated by reference).

The protein molecules of the present invention include plant homologue proteins. An example of such a homologue is a homologue protein of a non-maize or non-soybean plant species, that include but not limited to alfalfa, *Arabidopsis*, barley, *Brassica*, broccoli, cabbage, citrus, cotton, garlic, oat, oilseed rape, onion, canola, flax, an ornamental plant, pea, peanut, pepper, potato, rice, rye, sorghum, strawberry, sugarcane, sugarbeet, tomato, wheat, poplar, pine, fir, eucalyptus, apple, lettuce, lentils, grape, banana, tea, turf grasses, sunflower, oil palm, *Phaseolus* etc. Particularly preferred non-maize or non-soybean for use for the isolation of homologs would include, *Arabidopsis*, barley, cotton, oat, oilseed rape, rice, canola, ornamentals, sugarcane, sugarbeet, tomato, potato, wheat and turf grasses. Such a homologue can be obtained by any of a variety of methods. Most preferably, as indicated above, one or more of the disclosed sequences (SEQ ID NO: 1 through SEQ ID NO: 2814 or complements thereof) will be used to define a pair of primers that may be used to isolate the homologue-encoding nucleic acid molecules from any desired species. Such molecules can be expressed to yield homologues by recombinant means.

(c) Antibodies

One aspect of the present invention concerns antibodies, single-chain antigen binding molecules, or other proteins that specifically bind to one or more of the protein or peptide molecules of the present invention and their homologues, fusions or fragments. Such antibodies may be used to quantitatively or qualitatively detect the protein or peptide molecules of the present invention. As used herein, an antibody or peptide is said to "specifically bind" to a protein or peptide molecule of the present invention if such binding is not competitively inhibited by the presence of non-related molecules.

Nucleic acid molecules that encode all or part of the protein of the present invention can be expressed, via recombinant means, to yield protein or peptides that can in turn be used to elicit antibodies that are capable of binding the expressed protein or peptide. Such antibodies may be used in immunoassays for that protein. Such protein-encoding molecules, or their fragments may be a "fusion" molecule (i.e., a part of a larger nucleic acid molecule) such that, upon expression, a fusion protein is produced. It is understood that any of the nucleic acid molecules of the present invention may be expressed, via recombinant means, to yield proteins or peptides encoded by these nucleic acid molecules.

The antibodies that specifically bind proteins and protein fragments of the present invention may be polyclonal or monoclonal and may comprise intact immunoglobulins, or antigen binding portions of immunoglobulins fragments (such as (F(ab'), F(ab')$_2$), or single-chain immunoglobulins producible, for example, via recombinant means. It is understood that practitioners are familiar with the standard resource materials which describe specific conditions and procedures for the construction, manipulation and isolation of antibodies (see, for example, Harlow and Lane, In: *Antibodies: A Laboratory Manual*, Cold Spring Harbor Press, Cold Spring Harbor, N.Y. (1988), the entirety of which is herein incorporated by reference).

Murine monoclonal antibodies are particularly preferred. BALB/c mice are preferred for this purpose, however, equivalent strains may also be used. The animals are preferably immunized with approximately 25 µg of purified protein (or fragment thereof) that has been emulsified in a suitable adjuvant (such as TiterMax adjuvant (Vaxcel, Norcross, Ga.)). Immunization is preferably conducted at two intramuscular sites, one intraperitoneal site and one subcutaneous site at the base of the tail. An additional i.v. injection of approximately 25 µg of antigen is preferably given in normal saline three weeks later. After approximately 11 days following the second injection, the mice may be bled and the blood screened for the presence of anti-protein or peptide antibodies. Preferably, a direct binding Enzyme-Linked Immunoassay (ELISA) is employed for this purpose.

More preferably, the mouse having the highest antibody titer is given a third i.v. injection of approximately 25 µg of the same protein or fragment. The splenic leukocytes from this animal may be recovered 3 days later and then permitted to fuse, most preferably, using polyethylene glycol, with cells of a suitable myeloma cell line (such as, for example, the P3×63Ag8.653 myeloma cell line). Hybridoma cells are selected by culturing the cells under "HAT" (hypoxanthine-aminopterin-thymine) selection for about one week. The resulting clones may then be screened for their capacity to produce monoclonal antibodies ("mAbs"), preferably by direct ELISA.

In one embodiment, anti-protein or peptide monoclonal antibodies are isolated using a fusion of a protein or peptide of the present invention, or conjugate of a protein or peptide of the present invention, as immunogens. Thus, for example, a group of mice can be immunized using a fusion protein emulsified in Freund's complete adjuvant (e.g. approximately 50 µg of antigen per immunization). At three week intervals, an identical amount of antigen is emulsified in Freund's incomplete adjuvant and used to immunize the animals. Ten days following the third immunization, serum samples are taken and evaluated for the presence of antibody. If antibody titers are too low, a fourth booster can be employed. Polysera capable of binding the protein or peptide can also be obtained using this method.

In a preferred procedure for obtaining monoclonal antibodies, the spleens of the above-described immunized mice are removed, disrupted and immune splenocytes are isolated over a ficoll gradient. The isolated splenocytes are fused, using polyethylene glycol with BALB/c-derived HGPRT (hypoxanthine guanine phosphoribosyl transferase) deficient P3×63×Ag8.653 plasmacytoma cells. The fused cells are plated into 96 well microtiter plates and screened for hybridoma fusion cells by their capacity to grow in culture medium supplemented with hypothanthine, aminopterin and thymidine for approximately 2-3 weeks.

Hybridoma cells that arise from such incubation are preferably screened for their capacity to produce an immunoglobulin that binds to a protein of interest. An indirect ELISA may be used for this purpose. In brief, the supernatants of hybridomas are incubated in microtiter wells that contain immobilized protein. After washing, the titer of bound immunoglobulin can be determined using, for example, a goat anti-mouse antibody conjugated to horseradish peroxidase. After additional washing, the amount of immobilized enzyme is determined (for example through the use of a chromogenic substrate). Such screening is performed as quickly as possible after the identification of the hybridoma in order to ensure that a desired clone is not overgrown by non-secreting neighbor cells. Desirably, the fusion plates are screened several times since the rates of hybridoma growth vary. In a preferred sub-embodiment, a different antigenic form may be used to screen the hybridoma. Thus, for example, the splenocytes may be immunized with one immunogen, but the resulting hybridomas can be screened using a different immunogen. It is understood that any of the protein or peptide molecules of the present invention may be used to raise antibodies.

As discussed below, such antibody molecules or their fragments may be used for diagnostic purposes. Where the antibodies are intended for diagnostic purposes, it may be desirable to derivatize them, for example with a ligand group (such as biotin) or a detectable marker group (such as a fluorescent group, a radioisotope or an enzyme).

The ability to produce antibodies that bind the protein or peptide molecules of the present invention permits the identification of mimetic compounds of those molecules. A "mimetic compound" is a compound that is not that compound, or a fragment of that compound, but which nonetheless exhibits an ability to specifically bind to antibodies directed against that compound.

It is understood that any of the agents of the present invention can be substantially purified and/or be biologically active and/or recombinant.

Uses of the Agents of the Invention

Nucleic acid molecules and fragments thereof of the present invention may be employed to obtain other nucleic acid molecules from the same species (e.g., ESTs or fragment thereof from maize may be utilized to obtain other nucleic acid molecules from maize). Such nucleic acid molecules include the nucleic acid molecules that encode the complete coding sequence of a protein and promoters and flanking sequences of such molecules. In addition, such nucleic acid molecules include nucleic acid molecules that encode for other isozymes or gene family members. Such molecules can be readily obtained by using the above-described nucleic acid molecules or fragments thereof to screen cDNA or genomic libraries obtained from maize or soybean. Methods for forming such libraries are well known in the art.

Nucleic acid molecules and fragments thereof of the present invention may also be employed to obtain nucleic acid homologues. Such homologues include the nucleic acid molecule of other plants or other organisms (e.g., alfalfa, *Arabidopsis*, barley, *Brassica*, broccoli, cabbage, citrus, cotton, garlic, oat, oilseed rape, onion, canola, flax, an ornamental plant, pea, peanut, pepper, potato, rice, rye, sorghum, strawberry, sugarcane, sugarbeet, tomato, wheat, poplar, pine, fir, eucalyptus, apple, lettuce, lentils, grape, banana, tea, turf grasses, sunflower, oil palm, *Phaseolus*, etc.) including the nucleic acid molecules that encode, in whole or in part, protein homologues of other plant species or other organisms, sequences of genetic elements such as promoters and transcriptional regulatory elements. Such molecules can be readily obtained by using the above-described nucleic acid molecules or fragments thereof to screen cDNA or genomic libraries obtained from such plant species. Methods for forming such libraries are well known in the art. Such homologue molecules may differ in their nucleotide sequences from those found in one or more of SEQ ID NO: 1 through SEQ ID NO: 2814 or complements thereof because complete complementarity is not needed for stable hybridization. The nucleic acid molecules of the present invention therefore also include molecules that, although capable of specifically hybridizing with the nucleic acid molecules, may lack "complete complementarity."

Any of a variety of methods may be used to obtain one or more of the above-described nucleic acid molecules (Zamechik et al., *Proc. Natl. Acad. Sci.* (U.S.A.) 83:4143-4146 (1986), the entirety of which is herein incorporated by reference; Goodchild et al., *Proc. Natl. Acad. Sci.* (U.S.A.) 85:5507-5511 (1988), the entirety of which is herein incorporated by reference; Wickstrom et al., *Proc. Natl. Acad. Sci.* (U.S.A.) 85:1028-1032 (1988), the entirety of which is herein incorporated by reference; Holt et al., *Molec. Cell. Biol.* 8:963-973 (1988), the entirety of which is herein incorporated by reference; Gerwirtz et al., *Science* 242:1303-1306 (1988), the entirety of which is herein incorporated by reference; Anfossi et al., *Proc. Natl. Acad. Sci.* (U.S.A.) 86:3379-3383 (1989), the entirety of which is herein incorporated by reference; Becker et al., *EMBO J.* 8:3685-3691 (1989); the entirety of which is herein incorporated by reference). Automated nucleic acid synthesizers may be employed for this purpose. In lieu of such synthesis, the disclosed nucleic acid molecules may be used to define a pair of primers that can be used with the polymerase chain reaction (Mullis et al., *Cold Spring Harbor Symp. Quant. Biol.* 51:263-273 (1986); Erlich et al., European Patent 50,424; European Patent 84,796; European Patent 258,017; European Patent 237,362; Mullis, European Patent 201,184; Mullis et al., U.S. Pat. No. 4,683,202; Erlich, U.S. Pat. No. 4,582,788; and Saiki et al., U.S. Pat. No. 4,683,194, all of which are herein incorporated by reference in their entirety) to amplify and obtain any desired nucleic acid molecule or fragment.

Promoter sequence(s) and other genetic elements, including but not limited to transcriptional regulatory flanking sequences, associated with one or more of the disclosed nucleic acid sequences can also be obtained using the disclosed nucleic acid sequence provided herein. In one embodiment, such sequences are obtained by incubating EST nucleic acid molecules or preferably fragments thereof with members of genomic libraries (e.g. maize and soybean) and recovering clones that hybridize to the EST nucleic acid molecule or fragment thereof. In a second embodiment, methods of "chromosome walking," or inverse PCR may be used to obtain such sequences (Frohman et al., *Proc. Natl. Acad. Sci.* (U.S.A.) 85:8998-9002 (1988); Ohara et al., *Proc. Natl. Acad. Sci.*

(U.S.A.) 86:5673-5677 (1989); Pang et al., *Biotechniques* 22:1046-1048 (1977); Huang et al., *Methods Mol. Biol.* 69:89-96 (1997); Huang et al., *Method Mol. Biol.* 67:287-294 (1997); Benkel et al., *Genet. Anal.* 13:123-127 (1996); Hartl et al., *Methods Mol. Biol.* 58:293-301 (1996), all of which are herein incorporated by reference in their entirety).

The nucleic acid molecules of the present invention may be used to isolate promoters of cell enhanced, cell specific, tissue enhanced, tissue specific, developmentally or environmentally regulated expression profiles. Isolation and functional analysis of the 5' flanking promoter sequences of these genes from genomic libraries, for example, using genomic screening methods and PCR techniques would result in the isolation of useful promoters and transcriptional regulatory elements. These methods are known to those of skill in the art and have been described (See, for example, Birren et al., *Genome Analysis: Analyzing DNA*, 1, (1997), Cold Spring Harbor Laboratory Press, Cold Spring Harbor, N.Y., the entirety of which is herein incorporated by reference). Promoters obtained utilizing the nucleic acid molecules of the present invention could also be modified to affect their control characteristics. Examples of such modifications would include but are not limited to enhanced sequences as reported in Uses of the Agents of the Invention, Section (a) Plant Constructs and Plant Transformants. Such genetic elements could be used to enhance gene expression of new and existing traits for crop improvements.

In one sub-aspect, such an analysis is conducted by determining the presence and/or identity of polymorphism(s) by one or more of the nucleic acid molecules of the present invention and more preferably one or more of the EST nucleic acid molecule or fragment thereof which are associated with a phenotype, or a predisposition to that phenotype.

Any of a variety of molecules can be used to identify such polymorphism(s). In one embodiment, one or more of the EST nucleic acid molecules (or a sub-fragment thereof) may be employed as a marker nucleic acid molecule to identify such polymorphism(s). Alternatively, such polymorphisms can be detected through the use of a marker nucleic acid molecule or a marker protein that is genetically linked to (i.e., a polynucleotide that co-segregates with) such polymorphism(s).

In an alternative embodiment, such polymorphisms can be detected through the use of a marker nucleic acid molecule that is physically linked to such polymorphism(s). For this purpose, marker nucleic acid molecules comprising a nucleotide sequence of a polynucleotide located within 1 mb of the polymorphism(s) and more preferably within 100 kb of the polymorphism(s) and most preferably within 10 kb of the polymorphism(s) can be employed.

The genomes of animals and plants naturally undergo spontaneous mutation in the course of their continuing evolution (Gusella, *Ann. Rev. Biochem.* 55:831-854 (1986)). A "polymorphism" is a variation or difference in the sequence of the gene or its flanking regions that arises in some of the members of a species. The variant sequence and the "original" sequence co-exist in the species' population. In some instances, such co-existence is in stable or quasi-stable equilibrium.

A polymorphism is thus said to be "allelic," in that, due to the existence of the polymorphism, some members of a species may have the original sequence (i.e., the original "allele") whereas other members may have the variant sequence (i.e., the variant "allele"). In the simplest case, only one variant sequence may exist and the polymorphism is thus said to be di-allelic. In other cases, the species' population may contain multiple alleles and the polymorphism is termed tri-allelic, etc. A single gene may have multiple different unrelated polymorphisms. For example, it may have a di-allelic polymorphism at one site and a multi-allelic polymorphism at another site.

The variation that defines the polymorphism may range from a single nucleotide variation to the insertion or deletion of extended regions within a gene. In some cases, the DNA sequence variations are in regions of the genome that are characterized by short tandem repeats (STRs) that include tandem di- or tri-nucleotide repeated motifs of nucleotides. Polymorphisms characterized by such tandem repeats are referred to as "variable number tandem repeat" ("VNTR") polymorphisms. VNTRs have been used in identity analysis (Weber, U.S. Pat. No. 5,075,217; Armour et al., *FEBS Lett.* 307:113-115 (1992); Jones et al., *Eur. J. Haematol.* 39:144-147 (1987); Horn et al., PCT Patent Application WO91/14003; Jeffreys, European Patent Application 370,719; Jeffreys, U.S. Pat. No. 5,175,082; Jeffreys et al., *Amer. J. Hum. Genet.* 39:11-24 (1986); Jeffreys et al., *Nature* 316:76-79 (1985); Gray et al., *Proc. R. Acad. Soc. Lond.* 243:241-253 (1991); Moore et al., *Genomics* 10:654-660 (1991); Jeffreys et al., *Anim. Genet.* 18:1-15 (1987); Hillel et al., *Anim. Genet.* 20:145-155 (1989); Hillel et al., *Genet.* 124:783-789 (1990), all of which are herein incorporated by reference in their entirety).

The detection of polymorphic sites in a sample of DNA may be facilitated through the use of nucleic acid amplification methods. Such methods specifically increase the concentration of polynucleotides that span the polymorphic site, or include that site and sequences located either distal or proximal to it. Such amplified molecules can be readily detected by gel electrophoresis or other means.

The most preferred method of achieving such amplification employs the polymerase chain reaction ("PCR") (Mullis et al., *Cold Spring Harbor Symp. Quant. Biol.* 51:263-273 (1986); Erlich et al., European Patent Appln. 50,424; European Patent Appln. 84,796; European Patent Application 258,017; European Patent Appln. 237,362; Mullis, European Patent Appln. 201,184; Mullis et al., U.S. Pat. No. 4,683,202; Erlich, U.S. Pat. No. 4,582,788; and Saiki et al., U.S. Pat. No. 4,683,194), using primer pairs that are capable of hybridizing to the proximal sequences that define a polymorphism in its double-stranded form.

In lieu of PCR, alternative methods, such as the "Ligase Chain Reaction" ("LCR") may be used (Barany, *Proc. Natl. Acad. Sci.* (U.S.A.) 88:189-193 (1991), the entirety of which is herein incorporated by reference). LCR uses two pairs of oligonucleotide probes to exponentially amplify a specific target. The sequences of each pair of oligonucleotides is selected to permit the pair to hybridize to abutting sequences of the same strand of the target. Such hybridization forms a substrate for a template-dependent ligase. As with PCR, the resulting products thus serve as a template in subsequent cycles and an exponential amplification of the desired sequence is obtained.

LCR can be performed with oligonucleotides having the proximal and distal sequences of the same strand of a polymorphic site. In one embodiment, either oligonucleotide will be designed to include the actual polymorphic site of the polymorphism. In such an embodiment, the reaction conditions are selected such that the oligonucleotides can be ligated together only if the target molecule either contains or lacks the specific nucleotide that is complementary to the polymorphic site present on the oligonucleotide. Alternatively, the oligonucleotides may be selected such that they do not include the polymorphic site (see, Segev, PCT Application WO 90/01069, the entirety of which is herein incorporated by reference).

The "Oligonucleotide Ligation Assay" ("OLA") may alternatively be employed (Landegren et al., *Science* 241:1077-1080 (1988), the entirety of which is herein incorporated by reference). The OLA protocol uses two oligonucleotides which are designed to be capable of hybridizing to abutting sequences of a single strand of a target. OLA, like LCR, is particularly suited for the detection of point mutations. Unlike LCR, however, OLA results in "linear" rather than exponential amplification of the target sequence.

Nickerson et al., have described a nucleic acid detection assay that combines attributes of PCR and OLA (Nickerson et al., *Proc. Natl. Acad. Sci.* (U.S.A.) 87:8923-8927 (1990), the entirety of which is herein incorporated by reference). In this method, PCR is used to achieve the exponential amplification of target DNA, which is then detected using OLA. In addition to requiring multiple and separate, processing steps, one problem associated with such combinations is that they inherit all of the problems associated with PCR and OLA.

Schemes based on ligation of two (or more) oligonucleotides in the presence of nucleic acid having the sequence of the resulting "di-oligonucleotide", thereby amplifying the di-oligonucleotide, are also known (Wu et al., *Genomics* 4:560-569 (1989), the entirety of which is herein incorporated by reference) and may be readily adapted to the purposes of the present invention.

Other known nucleic acid amplification procedures, such as allele-specific oligomers, branched DNA technology, transcription-based amplification systems, or isothermal amplification methods may also be used to amplify and analyze such polymorphisms (Malek et al., U.S. Pat. No. 5,130,238; Davey et al., European Patent Application 329,822; Schuster et al., U.S. Pat. No. 5,169,766; Miller et al., PCT Patent Application WO 89/06700; Kwoh et al, *Proc. Natl. Acad. Sci.* (U.S.A.) 86:1173-1177 (1989); Gingeras et al., PCT Patent Application WO 88/10315; Walker et al., *Proc. Natl. Acad. Sci.* (U.S.A.) 89:392-396 (1992), all of which are herein incorporated by reference in their entirety).

The identification of a polymorphism can be determined in a variety of ways. By correlating the presence or absence of it in a plant with the presence or absence of a phenotype, it is possible to predict the phenotype of that plant. If a polymorphism creates or destroys a restriction endonuclease cleavage site, or if it results in the loss or insertion of DNA (e.g., a VNTR polymorphism), it will alter the size or profile of the DNA fragments that are generated by digestion with that restriction endonuclease. As such, individuals that possess a variant sequence can be distinguished from those having the original sequence by restriction fragment analysis. Polymorphisms that can be identified in this manner are termed "restriction fragment length polymorphisms" ("RFLPs"). RFLPs have been widely used in human and plant genetic analyses (Glassberg, UK Patent Application 2135774; Skolnick et al., *Cytogen. Cell Genet.* 32:58-67 (1982); Botstein et al., *Ann. J. Hum. Genet.* 32:314-331 (1980); Fischer et al., (PCT Application WO90/13668); Uhlen, PCT Application WO90/11369).

Polymorphisms can also be identified by Single Strand Conformation Polymorphism (SSCP) analysis. SSCP is a method capable of identifying most sequence variations in a single strand of DNA, typically between 150 and 250 nucleotides in length (Elles, *Methods in Molecular Medicine: Molecular Diagnosis of Genetic Diseases*, Humana Press (1996), the entirety of which is herein incorporated by reference); Orita et al., *Genomics* 5:874-879 (1989), the entirety of which is herein incorporated by reference). Under denaturing conditions a single strand of DNA will adopt a conformation that is uniquely dependent on its sequence conformation. This conformation usually will be different, even if only a single base is changed. Most conformations have been reported to alter the physical configuration or size sufficiently to be detectable by electrophoresis. A number of protocols have been described for SSCP including, but not limited to, Lee et al., *Anal. Biochem.* 205:289-293 (1992), the entirety of which is herein incorporated by reference; Suzuki et al., *Anal. Biochem.* 192:82-84 (1991), the entirety of which is herein incorporated by reference; Lo et al., *Nucleic Acids Research* 20:1005-1009 (1992), the entirety of which is herein incorporated by reference; Sarkar et al., *Genomics* 13:441-443 (1992), the entirety of which is herein incorporated by reference. It is understood that one or more of the nucleic acids of the present invention, may be utilized as markers or probes to detect polymorphisms by SSCP analysis.

Polymorphisms may also be found using a DNA fingerprinting technique called amplified fragment length polymorphism (AFLP), which is based on the selective PCR amplification of restriction fragments from a total digest of genomic DNA to profile that DNA (Vos et al., *Nucleic Acids Res.* 23:4407-4414 (1995), the entirety of which is herein incorporated by reference). This method allows for the specific co-amplification of high numbers of restriction fragments, which can be visualized by PCR without knowledge of the nucleic acid sequence.

AFLP employs basically three steps. Initially, a sample of genomic DNA is cut with restriction enzymes and oligonucleotide adapters are ligated to the restriction fragments of the DNA. The restriction fragments are then amplified using PCR by using the adapter and restriction sequence as target sites for primer annealing. The selective amplification is achieved by the use of primers that extend into the restriction fragments, amplifying only those fragments in which the primer extensions match the nucleotide flanking the restriction sites. These amplified fragments are then visualized on a denaturing polyacrylamide gel.

AFLP analysis has been performed on Salix (Beismann et al., *Mol. Ecol.* 6:989-993 (1997), the entirety of which is herein incorporated by reference), *Acinetobacter* (Janssen et al., *Int. J. Syst. Bacteriol.* 47:1179-1187 (1997), the entirety of which is herein incorporated by reference), *Aeromonas popoffi* (Huys et al., *Int. J. Syst. Bacteriol.* 47:1165-1171 (1997), the entirety of which is herein incorporated by reference), rice (McCouch et al., *Plant Mol. Biol.* 35:89-99 (1997), the entirety of which is herein incorporated by reference; Nandi et al., *Mol. Gen. Genet.* 255:1-8 (1997), the entirety of which is herein incorporated by reference; Cho et al., *Genome* 39:373-378 (1996), the entirety of which is herein incorporated by reference), barley (*Hordeum vulgare*)(Simons et al., *Genomics* 44:61-70 (1997), the entirety of which is herein incorporated by reference; Waugh et al, *Mol. Gen. Genet.* 255:311-321 (1997), the entirety of which is herein incorporated by reference; Qi et al., *Mol. Gen Genet.* 254:330-336 (1997), the entirety of which is herein incorporated by reference; Becker et al., *Mol. Gen. Genet.* 249:65-73 (1995), the entirety of which is herein incorporated by reference), potato (Van der Voort et al., *Mol. Gen. Genet.* 255:438-447 (1997), the entirety of which is herein incorporated by reference; Meksem et al., *Mol. Gen. Genet.* 249:74-81 (1995), the entirety of which is herein incorporated by reference), *Phytophthora infestans* (Van der Lee et al., *Fungal Genet. Biol.* 21:278-291 (1997), the entirety of which is herein incorporated by reference), *Bacillus anthracis* (Keim et al., *J. Bacteriol.* 179:818-824 (1997), the entirety of which is herein incorporated by reference), *Astragalus cremnophylax* (Travis et al., *Mol. Ecol.* 5:735-745 (1996), the entirety of which is herein incorporated by reference), *Arabidopsis* (Cnops et al., *Mol. Gen. Genet.* 253:32-41 (1996), the entirety of which is herein incorporated by reference), *Escherichia coli* (Lin et al., *Nucleic Acids Res.* 24:3649-3650 (1996), the entirety of which is herein incorporated by reference), Aeromonas (Huys et al., *Int. J. Syst. Bacteriol.* 46:572-580 (1996), the entirety of which is herein incorporated by reference), nematode (Folkertsma et al., *Mol. Plant Microbe Interact.* 9:47-54 (1996), the entirety of which is herein incorporated by reference), tomato (Thomas et al., *Plant J.* 8:785-794 (1995), the entirety of which is herein incorporated by reference) and human (Latorra et al., *PCR Methods Appl.* 3:351-358 (1994), the entirety of which is herein incorporated by reference). AFLP analysis has also been used for fingerprinting mRNA (Money et al., *Nucleic Acids Res.* 24:2616-2617 (1996), the entirety of which is herein incorporated by reference; Bachem et al., *Plant J.* 9:745-753 (1996), the entirety of which is herein incorporated by reference). It is understood that one or more of the nucleic acids of the present invention, may be utilized as markers or probes to detect polymorphisms by AFLP analysis or for fingerprinting RNA.

Polymorphisms may also be found using random amplified polymorphic DNA (RAPD) (Williams et al., *Nucl. Acids Res.* 18:6531-6535 (1990), the entirety of which is herein incorporated by reference) and cleaveable amplified polymorphic sequences (CAPS) (Lyamichev et al, *Science* 260:778-783 (1993), the entirety of which is herein incorporated by reference). It is understood that one or more of the nucleic acid molecules of the present invention, may be utilized as markers or probes to detect polymorphisms by RAPD or CAPS analysis.

Through genetic mapping, a fine scale linkage map can be developed using DNA markers and, then, a genomic DNA library of large-sized fragments can be screened with molecular markers linked to the desired trait. Molecular markers are advantageous for agronomic traits that are otherwise difficult to tag, such as resistance to pathogens, insects and nematodes, tolerance to abiotic stress, quality parameters and quantitative traits such as high yield potential.

The essential requirements for marker-assisted selection in a plant breeding program are: (1) the marker(s) should co-segregate or be closely linked with the desired trait; (2) an efficient means of screening large populations for the molecular marker(s) should be available; and (3) the screening technique should have high reproducibility across laboratories and preferably be economical to use and be user-friendly.

The genetic linkage of marker molecules can be established by a gene mapping model such as, without limitation, the flanking marker model reported by Lander and Botstein, *Genetics* 121:185-199 (1989) and the interval mapping, based on maximum likelihood methods described by Lander and Botstein, *Genetics* 121:185-199 (1989) and implemented in the software package MAPMAKER/QTL (Lincoln and Lander, *Mapping Genes Controlling Quantitative Traits Using MAPMAKER/QTL*, Whitehead Institute for Biomedical Research, Massachusetts, (1990). Additional software includes Qgene, Version 2.23 (1996), Department of Plant Breeding and Biometry, 266 Emerson Hall, Cornell University, Ithaca, N.Y., the manual of which is herein incorporated by reference in its entirety). Use of Qgene software is a particularly preferred approach.

A maximum likelihood estimate (MLE) for the presence of a marker is calculated, together with an MLE assuming no QTL effect, to avoid false positives. A $\log_{10}$ of an odds ratio (LOD) is then calculated as: LOD=$\log_{10}$ (MLE for the presence of a QTL/MLE given no linked QTL).

The LOD score essentially indicates how much more likely the data are to have arisen assuming the presence of a QTL than in its absence. The LOD threshold value for avoiding a false positive with a given confidence, say 95%, depends on the number of markers and the length of the genome. Graphs indicating LOD thresholds are set forth in Lander and Botstein, *Genetics* 121:185-199 (1989) the entirety of which is herein incorporated by reference and further described by Arús and Moreno-González, *Plant Breeding*, Hayward et al., (eds.) Chapman & Hall, London, pp. 314-331 (1993), the entirety of which is herein incorporated by reference.

Additional models can be used. Many modifications and alternative approaches to interval mapping have been reported, including the use non-parametric methods (Kruglyak and Lander, *Genetics* 139:1421-1428 (1995), the entirety of which is herein incorporated by reference). Multiple regression methods or models can be also be used, in which the trait is regressed on a large number of markers (Jansen, *Biometrics in Plant Breeding*, van Oijen and Jansen (eds.), Proceedings of the Ninth Meeting of the Eucarpia Section Biometrics in Plant Breeding, The Netherlands, pp. 116-124 (1994); Weber and Wricke, *Advances in Plant Breeding*, Blackwell, Berlin, 16 (1994), both of which is herein incorporated by reference in their entirety). Procedures combining interval mapping with regression analysis, whereby the phenotype is regressed onto a single putative QTL at a given marker interval and at the same time onto a number of markers that serve as 'cofactors,' have been reported by Jansen and Stam, *Genetics* 136:1447-1455 (1994), the entirety of which is herein incorporated by reference and Zeng, *Genetics* 136:1457-1468 (1994) the entirety of which is herein incorporated by reference. Generally, the use of cofactors reduces the bias and sampling error of the estimated QTL positions (Utz and Melchinger, *Biometrics in Plant Breeding*, van Oijen and Jansen (eds.) Proceedings of the Ninth Meeting of the Eucarpia Section Biometrics in Plant Breeding, The Netherlands, pp.195-204 (1994), the entirety of which is herein incorporated by reference, thereby improving the precision and efficiency of QTL mapping (Zeng, *Genetics* 136:1457-1468 (1994)). These models can be extended to multi-environment experiments to analyze genotype-environment interactions (Jansen et al., *Theo. Appl. Genet.* 91:33-37 (1995), the entirety of which is herein incorporated by reference).

Selection of an appropriate mapping populations is important to map construction. The choice of appropriate mapping population depends on the type of marker systems employed (Tanksley et al., *Molecular mapping plant chromosomes. Chromosome structure and function: Impact of new concepts*, Gustafson and Appels (eds.), Plenum Press, New York, pp 157-173 (1988), the entirety of which is herein incorporated by reference). Consideration must be given to the source of parents (adapted vs. exotic) used in the mapping population. Chromosome pairing and recombination rates can be severely disturbed (suppressed) in wide crosses (adapted×exotic) and generally yield greatly reduced linkage distances. Wide crosses will usually provide segregating populations with a relatively large array of polymorphisms when compared to progeny in a narrow cross (adapted×adapted).

An $F_2$ population is the first generation of selfing after the hybrid seed is produced. Usually a single $F_1$ plant is selfed to generate a population segregating for all the genes in Mendelian (1:2:1) fashion. Maximum genetic information is obtained from a completely classified $F_2$ population using a codominant marker system (Mather, *Measurement of Link-* age in *Heredity*, Methuen and Co., (1938), the entirety of which is herein incorporated by reference). In the case of dominant markers, progeny tests (e.g. $F_3$, $BCF_2$) are required to identify the heterozygotes, thus making it equivalent to a completely classified $F_2$ population. However, this procedure is often prohibitive because of the cost and time involved in progeny testing. Progeny testing of $F_2$ individuals is often used in map construction where phenotypes do not consistently reflect genotype (e.g. disease resistance) or where trait expression is controlled by a QTL. Segregation data from progeny test populations (e.g. $F_3$ or $BCF_2$) can be used in map construction. Marker-assisted selection can then be applied to cross progeny based on marker-trait map associations ($F_2$, $F_3$), where linkage groups have not been completely disassociated by recombination events (i.e., maximum disequillibrium).

Recombinant inbred lines (RIL) (genetically related lines; usually >$F_5$, developed from continuously selfing $F_2$ lines towards homozygosity) can be used as a mapping population. Information obtained from dominant markers can be maximized by using RIL because all loci are homozygous or nearly so. Under conditions of tight linkage (i.e., about <10% recombination), dominant and co-dominant markers evaluated in RIL populations provide more information per individual than either marker type in backcross populations (Reiter et al., *Proc. Natl. Acad. Sci.* (U.S.A.) 89:1477-1481 (1992), the entirety of which is herein incorporated by reference). However, as the distance between markers becomes larger (i.e., loci become more independent), the information in RIL populations decreases dramatically when compared to codominant markers.

Backcross populations (e.g., generated from a cross between a successful variety (recurrent parent) and another variety (donor parent) carrying a trait not present in the former) can be utilized as a mapping population. A series of backcrosses to the recurrent parent can be made to recover most of its desirable traits. Thus a population is created consisting of individuals nearly like the recurrent parent but each individual carries varying amounts or mosaic of genomic regions from the donor parent. Backcross populations can be useful for mapping dominant markers if all loci in the recurrent parent are homozygous and the donor and recurrent parent have contrasting polymorphic marker alleles (Reiter et al., *Proc. Natl. Acad. Sci.* (U.S.A.) 89:1477-1481 (1992)). Information obtained from backcross populations using either codominant or dominant markers is less than that obtained from $F_2$ populations because one, rather than two, recombinant gametes are sampled per plant. Backcross populations, however, are more informative (at low marker saturation) when compared to RILs as the distance between linked loci increases in RIL populations (i.e. about 15% recombination). Increased recombination can be beneficial for resolution of tight linkages, but may be undesirable in the construction of maps with low marker saturation.

Near-isogenic lines (NIL) created by many backcrosses to produce an array of individuals that are nearly identical in genetic composition except for the trait or genomic region under interrogation can be used as a mapping population. In mapping with NILs, only a portion of the polymorphic loci are expected to map to a selected region.

Bulk segregant analysis (BSA) is a method developed for the rapid identification of linkage between markers and traits of interest (Michelmore et al., *Proc. Natl. Acad. Sci.* (U.S.A.) 88:9828-9832 (1991), the entirety of which is herein incorporated by reference). In BSA, two bulked DNA samples are drawn from a segregating population originating from a single cross. These bulks contain individuals that are identical for a particular trait (resistant or susceptible to particular disease) or genomic region but arbitrary at unlinked regions (i.e. heterozygous). Regions unlinked to the target region will not differ between the bulked samples of many individuals in BSA.

It is understood that one or more of the nucleic acid molecules of the present invention may be used as molecular markers. It is also understood that one or more of the protein molecules of the present invention may be used as molecular markers.

In accordance with this aspect of the present invention, a sample nucleic acid is obtained from plants cells or tissues. Any source of nucleic acid may be used. Preferably, the nucleic acid is genomic DNA. The nucleic acid is subjected to restriction endonuclease digestion. For example, one or more nucleic acid molecule or fragment thereof of the present invention can be used as a probe in accordance with the above-described polymorphic methods. The polymorphism obtained in this approach can then be cloned to identify the mutation at the coding region which alters the protein's structure or regulatory region of the gene which affects its expression level.

In an aspect of the present invention, one or more of the nucleic molecules of the present invention are used to determine the level (i.e., the concentration of mRNA in a sample, etc.) in a plant (preferably maize or soybean) or pattern (i.e., the kinetics of expression, rate of decomposition, stability profile, etc.) of the expression of a protein encoded in part or whole by one or more of the nucleic acid molecule of the present invention (collectively, the "Expression Response" of a cell or tissue). As used herein, the Expression Response manifested by a cell or tissue is said to be "altered" if it differs from the Expression Response of cells or tissues of plants not exhibiting the phenotype. To determine whether a Expression Response is altered, the Expression Response manifested by the cell or tissue of the plant exhibiting the phenotype is compared with that of a similar cell or tissue sample of a plant not exhibiting the phenotype. As will be appreciated, it is not necessary to re-determine the Expression Response of the cell or tissue sample of plants not exhibiting the phenotype each time such a comparison is made; rather, the Expression Response of a particular plant may be compared with previously obtained values of normal plants. As used herein, the phenotype of the organism is any of one or more characteristics of an organism (e.g. disease resistance, pest tolerance, environmental tolerance such as tolerance to abiotic stress, male sterility, quality improvement or yield etc.). A change in genotype or phenotype may be transient or permanent. Also as used herein, a tissue sample is any sample that comprises more than one cell. In a preferred aspect, a tissue sample comprises cells that share a common characteristic (e.g. derived from root, seed, flower, leaf, stem or pollen etc.).

In one aspect of the present invention, an evaluation can be conducted to determine whether a particular mRNA molecule is present. One or more of the nucleic acid molecules of the present invention, preferably one or more of the EST nucleic acid molecules or fragments thereof of the present invention are utilized to detect the presence or quantity of the mRNA species. Such molecules are then incubated with cell or tissue extracts of a plant under conditions sufficient to permit nucleic acid hybridization. The detection of double-stranded probe-mRNA hybrid molecules is indicative of the presence of the mRNA; the amount of such hybrid formed is proportional to the amount of mRNA. Thus, such probes may be used to ascertain the level and extent of the mRNA production in a plant's cells or tissues. Such nucleic acid hybridization may be conducted under quantitative conditions (thereby providing a numerical value of the amount of the mRNA present). Alternatively, the assay may be conducted as a qualitative assay that indicates either that the mRNA is present, or that its level exceeds a user set, predefined value.

A principle of in situ hybridization is that a labeled, single-stranded nucleic acid probe will hybridize to a complementary strand of cellular DNA or RNA and, under the appropriate conditions, these molecules will form a stable hybrid. When nucleic acid hybridization is combined with histological techniques, specific DNA or RNA sequences can be identified within a single cell. An advantage of in situ hybridization over more conventional techniques for the detection of nucleic acids is that it allows an investigator to determine the precise spatial population (Angerer et al., *Dev. Biol.* 101:477-484 (1984), the entirety of which is herein incorporated by reference; Angerer et al., *Dev. Biol.* 112:157-166 (1985), the entirety of which is herein incorporated by reference; Dixon et al., *EMBO J.* 10:1317-1324 (1991), the entirety of which is herein incorporated by reference). In situ hybridization may be used to measure the steady-state level of RNA accumulation. It is a sensitive technique and RNA sequences present in as few as 5-10 copies per cell can be detected (Hardin et al., *J. Mol. Biol.* 202:417-431 (1989), the entirety of which is herein incorporated by reference). A number of protocols have been devised for in situ hybridization, each with tissue preparation, hybridization and washing conditions (Meyerowitz, *Plant Mol. Biol. Rep.* 5:242-250 (1987), the entirety of which is herein incorporated by reference; Cox and Goldberg, In: *Plant Molecular Biology: A Practical Approach*, Shaw (ed.), pp 1-35, IRL Press, Oxford (1988), the entirety of which is herein incorporated by reference; Raikhel et al., *In situ RNA hybridization in plant tissues*, In: *Plant Molecular Biology Manual*, vol. B9:1-32, Kluwer Academic Publisher, Dordrecht, Belgium (1989), the entirety of which is herein incorporated by reference).

In situ hybridization also allows for the localization of proteins within a tissue or cell (Wilkinson, *In Situ Hybridization*, Oxford University Press, Oxford (1992), the entirety of which is herein incorporated by reference; Langdale, *In Situ Hybridization* In: *The Maize Handbook*, Freeling and Walbot (eds.), pp 165-179, Springer-Verlag, New York (1994), the entirety of which is herein incorporated by reference). It is understood that one or more of the molecules of the present invention, preferably one or more of the EST nucleic acid molecules or fragments thereof of the present invention or one or more of the antibodies of the present invention may be utilized to detect the level or pattern of a sucrose pathway protein or mRNA thereof by in situ hybridization.

Fluorescent in situ hybridization allows the localization of a particular DNA sequence along a chromosome which is useful, among other uses, for gene mapping, following chromosomes in hybrid lines or detecting chromosomes with translocations, transversions or deletions. In situ hybridization has been used to identify chromosomes in several plant species (Griffor et al., *Plant Mol. Biol.* 17:101-109 (1991), the entirety of which is herein incorporated by reference; Gustafson et al., *Proc. Natl. Acad. Sci.* (U.S.A.) 87:1899-1902 (1990), herein incorporated by reference; Mukai and Gill, *Genome* 34:448-452 (1991), the entirety of which is herein incorporated by reference; Schwarzacher and Heslop-Harrison, *Genome* 34:317-323 (1991); Wang et al., *Jpn. J. Genet.* 66:313-316 (1991), the entirety of which is herein incorporated by reference; Parra and Windle, *Nature Genetics* 5:17-21 (1993), the entirety of which is herein incorporated by reference). It is understood that the nucleic acid molecules of the present invention may be used as probes or markers to localize sequences along a chromosome.

Another method to localize the expression of a molecule is tissue printing. Tissue printing provides a way to screen, at the same time on the same membrane many tissue sections from different plants or different developmental stages. Tissue-printing procedures utilize films designed to immobilize proteins and nucleic acids. In essence, a freshly cut section of a tissue is pressed gently onto nitrocellulose paper, nylon membrane or polyvinylidene difluoride membrane. Such membranes are commercially available (e.g. Millipore, Bedford, Mass. U.S.A.). The contents of the cut cell transfer onto the membrane and the contents and are immobilized to the membrane. The immobilized contents form a latent print that can be visualized with appropriate probes. When a plant tissue print is made on nitrocellulose paper, the cell walls leave a physical print that makes the anatomy visible without further treatment (Varner and Taylor, *Plant Physiol.* 91:31-33 (1989), the entirety of which is herein incorporated by reference).

Tissue printing on substrate films is described by Daoust, *Exp. Cell Res.* 12:203-211 (1957), the entirety of which is herein incorporated by reference, who detected amylase, protease, ribonuclease and deoxyribonuclease in animal tissues using starch, gelatin and agar films. These techniques can be applied to plant tissues (Yomo and Taylor, *Planta* 112:35-43 (1973); the entirety of which is herein incorporated by reference; Harris and Chrispeels, *Plant Physiol.* 56:292-299 (1975), the entirety of which is herein incorporated by reference). Advances in membrane technology have increased the range of applications of Daoust's tissue-printing techniques allowing (Cassab and Varner, *J. Cell. Biol.* 105:2581-2588 (1987), the entirety of which is herein incorporated by reference) the histochemical localization of various plant enzymes and deoxyribonuclease on nitrocellulose paper and nylon (Spruce et al., *Phytochemistry* 26:2901-2903 (1987), the entirety of which is herein incorporated by reference; Barres et al., *Neuron* 5:527-544 (1990), the entirety of which is herein incorporated by reference; Reid and Pont-Lezica, *Tissue Printing: Tools for the Study of Anatomy, Histochemistry and Gene Expression*, Academic Press, New York, N.Y. (1992), the entirety of which is herein incorporated by reference; Reid et al., *Plant Physiol.* 93:160-165 (1990), the entirety of which is herein incorporated by reference; Ye et al., *Plant J.* 1:175-183 (1991), the entirety of which is herein incorporated by reference).

It is understood that one or more of the molecules of the present invention, preferably one or more of the EST nucleic acid molecules or fragments thereof of the present invention or one or more of the antibodies of the present invention may be utilized to detect the presence or quantity of a sucrose pathway protein by tissue printing.

Further it is also understood that any of the nucleic acid molecules of the present invention may be used as marker nucleic acids and or probes in connection with methods that require probes or marker nucleic acids. As used herein, a probe is an agent that is utilized to determine an attribute or feature (e.g. presence or absence, location, correlation, etc.) of a molecule, cell, tissue or plant. As used herein, a marker nucleic acid is a nucleic acid molecule that is utilized to determine an attribute or feature (e.g., presence or absence, location, correlation, etc.) or a molecule, cell, tissue or plant.

A microarray-based method for high-throughput monitoring of plant gene expression may be utilized to measure gene-specific hybridization targets. This 'chip'-based approach involves using microarrays of nucleic acid molecules as gene-specific hybridization targets to quantitatively measure expression of the corresponding plant genes (Schena et al., *Science* 270:467-470 (1995), the entirety of which is herein incorporated by reference; Shalon, Ph.D. Thesis, Stanford University (1996), the entirety of which is herein incorporated by reference). Every nucleotide in a large sequence can be queried at the same time. Hybridization can be used to efficiently analyze nucleotide sequences.

Several microarray methods have been described. One method compares the sequences to be analyzed by hybridization to a set of oligonucleotides representing all possible subsequences (Bains and Smith, *J. Theor. Biol.* 135:303-307 (1989), the entirety of which is herein incorporated by reference). A second method hybridizes the sample to an array of oligonucleotide or cDNA molecules. An array consisting of oligonucleotides complementary to subsequences of a target sequence can be used to determine the identity of a target sequence, measure its amount and detect differences between the target and a reference sequence. Nucleic acid molecules microarrays may also be screened with protein molecules or fragments thereof to determine nucleic acid molecules that specifically bind protein molecules or fragments thereof.

The microarray approach may be used with polypeptide targets (U.S. Pat. Nos. 5,445,934; 5,143,854; 5,079,600; 4,923,901, all of which are herein incorporated by reference in their entirety). Essentially, polypeptides are synthesized on a substrate (microarray) and these polypeptides can be screened with either protein molecules or fragments thereof or nucleic acid molecules in order to screen for either protein molecules or fragments thereof or nucleic acid molecules that specifically bind the target polypeptides. (Fodor et al., *Science* 251:767-773 (1991), the entirety of which is herein incorporated by reference). It is understood that one or more of the nucleic acid molecules or protein or fragments thereof of the present invention may be utilized in a microarray based method.

In a preferred embodiment of the present invention microarrays may be prepared that comprise nucleic acid molecules where such nucleic acid molecules encode at least one, preferably at least two, more preferably at least three or preferably at least four, preferably at least five, preferably at least six, preferably at least seven, preferably at least eight, preferably at least nine, preferably at least ten, preferably at least eleven, preferably at least twelve, preferably at least thirteen, preferably at least fourteen preferably at least fifteen sucrose pathway enzymes. In a preferred embodiment the nucleic acid molecules are selected from the group consisting of a nucleic acid molecule that encodes a maize or a soybean triose phosphate isomerase enzyme or fragment thereof, a nucleic acid molecule that encodes a maize or a soybean fructose 1,6-bisphosphate aldolase enzyme or fragment thereof, a nucleic acid molecule that encodes a maize or a soybean fructose 1,6-bisphosphate enzyme or fragment thereof, a nucleic acid molecule that encodes a maize or a soybean fructose 6-phosphate 2-kinase enzyme or fragment thereof, a nucleic acid molecule that encodes a maize or a soybean phosphoglucoisomerase enzyme or fragment thereof, a nucleic acid molecule that encodes a maize or a soybean vacuolar $H^+$ translocating-pyrophosphatase enzyme or fragment thereof, a nucleic acid molecule that encodes a maize or a soybean pyrophosphate-dependent fructose-6-phosphate phosphotransferase enzyme or fragment thereof, a nucleic acid molecule that encodes a maize or a soybean invertase enzyme or fragment thereof, a nucleic acid molecule that encodes a maize or a soybean sucrose synthase enzyme or fragment thereof, a nucleic acid molecule that encodes a maize or a soybean hexokinase enzyme or fragment thereof, a nucleic acid molecule that encodes a maize or a soybean fructokinase enzyme or fragment thereof, a nucleic acid molecule that encodes a maize or a soybean NDP-kinase enzyme or fragment thereof, a nucleic acid molecule that encodes a maize or a soybean glucose-6-phosphate 1-dehydrogenase enzyme or fragment thereof, a nucleic acid molecule that encodes a maize or a soybean phosphoglucomutase enzyme or fragment thereof and a nucleic acid molecule that encodes a maize or a soybean UDP-glucose pyrophophorylase enzyme or fragment thereof.

Site directed mutagenesis may be utilized to modify nucleic acid sequences, particularly as it is a technique that allows one or more of the amino acids encoded by a nucleic acid molecule to be altered (e.g. a threonine to be replaced by a methionine). Three basic methods for site directed mutagenesis are often employed. These are cassette mutagenesis (Wells et al., *Gene* 34:315-323 (1985), the entirety of which is herein incorporated by reference), primer extension (Gilliam et al., *Gene* 12:129-137 (1980), the entirety of which is herein incorporated by reference; Zoller and Smith, *Methods Enzymol.* 100:468-500 (1983), the entirety of which is herein incorporated by reference; Dalbadie-McFarland et al., *Proc. Natl. Acad. Sci.* (U.S.A.) 79:6409-6413 (1982), the entirety of which is herein incorporated by reference) and methods based upon PCR (Scharf et al., *Science* 233:1076-1078 (1986), the entirety of which is herein incorporated by reference; Higuchi et al, *Nucleic Acids Res.* 16:7351-7367 (1988), the entirety of which is herein incorporated by reference). Site directed mutagenesis approaches are also described in European Patent 0 385 962, the entirety of which is herein incorporated by reference; European Patent 0 359 472, the entirety of which is herein incorporated by reference; and PCT Patent Application WO 93/07278, the entirety of which is herein incorporated by reference.

Site directed mutagenesis strategies have been applied to plants for both in vitro as well as in vivo site directed mutagenesis (Lanz et al., *J. Biol. Chem.* 266:9971-9976 (1991), the entirety of which is herein incorporated by reference; Kovgan and Zhdanov, *Biotekhnologiya* 5:148-154; No. 207160n, Chemical Abstracts 110:225 (1989), the entirety of which is herein incorporated by reference; Ge et al., *Proc. Natl. Acad. Sci.* (U.S.A.) 86:4037-4041 (1989), the entirety of which is herein incorporated by reference; Zhu et al., *J. Biol. Chem.* 271:18494-18498 (1996), the entirety of which is herein incorporated by reference; Chu et al., *Biochemistry* 33:6150-6157 (1994), the entirety of which is herein incorporated by reference; Small et al., *EMBO J.* 11:1291-1296 (1992), the entirety of which is herein incorporated by reference; Cho et al., *Mol. Biotechnol.* 8:13-16 (1997), the entirety of which is herein incorporated by reference; Kita et al., *J. Biol. Chem.* 271:26529-26535 (1996), the entirety of which is herein incorporated by reference, Jin et al., *Mol. Microbiol.* 7:555-562 (1993), the entirety of which is herein incorporated by reference; Hatfield and Vierstra, *J. Biol. Chem.* 267:14799-14803 (1992), the entirety of which is herein incorporated by reference; Zhao et al., *Biochemistry* 31:5093-5099 (1992), the entirety of which is herein incorporated by reference).

Any of the nucleic acid molecules of the present invention may either be modified by site directed mutagenesis or used as, for example, nucleic acid molecules that are used to target other nucleic acid molecules for modification. It is understood that mutants with more than one altered nucleotide can be constructed using techniques that practitioners are familiar with such as isolating restriction fragments and ligating such fragments into an expression vector (see, for example, Sambrook et al., *Molecular Cloning: A Laboratory Manual*, Cold Spring Harbor Press (1989)).

Sequence-specific DNA-binding proteins play a role in the regulation of transcription. The isolation of recombinant cDNAs encoding these proteins facilitates the biochemical analysis of their structural and functional properties. Genes encoding such DNA-binding proteins have been isolated using classical genetics (Vollbrecht et al., *Nature* 350: 241-243 (1991), the entirety of which is herein incorporated by reference) and molecular biochemical approaches, including the screening of recombinant cDNA libraries with antibodies (Landschulz et al., *Genes Dev.* 2:786-800 (1988), the entirety of which is herein incorporated by reference) or DNA probes (Bodner et al., *Cell* 55:505-518 (1988), the entirety of which is herein incorporated by reference). In addition, an in situ screening procedure has been used and has facilitated the isolation of sequence-specific DNA-binding proteins from various plant species (Gilmartin et al., *Plant Cell* 4:839-849 (1992), the entirety of which is herein incorporated by reference; Schindler et al., *EMBO J.* 11:1261-1273 (1992), the entirety of which is herein incorporated by reference). An in situ screening protocol does not require the purification of the protein of interest (Vinson et al., *Genes Dev.* 2:801-806 (1988), the entirety of which is herein incorporated by reference; Singh et al., *Cell* 52:415-423 (1988), the entirety of which is herein incorporated by reference).

Two steps may be employed to characterize DNA-protein interactions. The first is to identify promoter fragments that interact with DNA-binding proteins, to titrate binding activity, to determine the specificity of binding and to determine whether a given DNA-binding activity can interact with related DNA sequences (Sambrook et al., *Molecular Cloning: A Laboratory Manual*, $2^{nd}$ edition, Cold Spring Harbor Laboratory Press, Cold Spring Harbor, N.Y. (1989)). Electrophoretic mobility-shift assay is a widely used assay. The assay provides a rapid and sensitive method for detecting DNA-binding proteins based on the observation that the mobility of a DNA fragment through a nondenaturing, low-ionic strength polyacrylamide gel is retarded upon association with a DNA-binding protein (Fried and Crother, *Nucleic Acids Res.* 9:6505-6525 (1981), the entirety of which is herein incorporated by reference). When one or more specific binding activities have been identified, the exact sequence of the DNA bound by the protein may be determined. Several procedures for characterizing protein/DNA-binding sites are used, including methylation and ethylation interference assays (Maxam and Gilbert, *Methods Enzymol.* 65:499-560 (1980), the entirety of which is herein incorporated by reference; Wissman and Hillen, *Methods Enzymol.* 208:365-379 (1991), the entirety of which is herein incorporated by reference), footprinting techniques employing DNase I (Galas and Schmitz, *Nucleic Acids Res.* 5:3157-3170 (1978), the entirety of which is herein incorporated by reference), 1,10-phenanthroline-copper ion methods (Sigman et al., *Methods Enzymol.* 208:414-433 (1991), the entirety of which is herein incorporated by reference) and hydroxyl radicals methods (Dixon et al, *Methods Enzymol.* 208:414-433 (1991), the entirety of which is herein incorporated by reference). It is understood that one or more of the nucleic acid molecules of the present invention may be utilized to identify a protein or fragment thereof that specifically binds to a nucleic acid molecule of the present invention. It is also understood that one or more of the protein molecules or fragments thereof of the present invention may be utilized to identify a nucleic acid molecule that specifically binds to it.

A two-hybrid system is based on the fact that many cellular functions are carried out by proteins, such as transcription factors, that interact (physically) with one another. Two-hybrid systems have been used to probe the function of new proteins (Chien et al., *Proc. Natl. Acad. Sci.* (U.S.A.) 88:9578-9582 (1991) the entirety of which is herein incorporated by reference; Durfee et al., *Genes Dev.* 7:555-569 (1993) the entirety of which is herein incorporated by reference; Choi et al., *Cell* 78:499-512 (1994), the entirety of which is herein incorporated by reference; Kranz et al., *Genes Dev.* 8:313-327 (1994), the entirety of which is herein incorporated by reference).

Interaction mating techniques have facilitated a number of two-hybrid studies of protein-protein interaction. Interaction mating has been used to examine interactions between small sets of tens of proteins (Finley and Brent, *Proc. Natl. Acad. Sci.* (U.S.A.) 91:12098-12984 (1994), the entirety of which is herein incorporated by reference), larger sets of hundreds of proteins (Bendixen et al., *Nucl. Acids Res.* 22:1778-1779 (1994), the entirety of which is herein incorporated by reference) and to comprehensively map proteins encoded by a small genome (Bartel et al., *Nature Genetics* 12:72-77 (1996), the entirety of which is herein incorporated by reference). This technique utilizes proteins fused to the DNA-binding domain and proteins fused to the activation domain. They are expressed in two different haploid yeast strains of opposite mating type and the strains are mated to determine if the two proteins interact. Mating occurs when haploid yeast strains come into contact and result in the fusion of the two haploids into a diploid yeast strain. An interaction can be determined by the activation of a two-hybrid reporter gene in the diploid strain. An advantage of this technique is that it reduces the number of yeast transformations needed to test individual interactions. It is understood that the protein-protein interactions of protein or fragments thereof of the present invention may be investigated using the two-hybrid system and that any of the nucleic acid molecules of the present invention that encode such proteins or fragments thereof may be used to transform yeast in the two-hybrid system.

(a) Plant Constructs and Plant Transformants

One or more of the nucleic acid molecules of the present invention may be used in plant transformation or transfection. Exogenous genetic material may be transferred into a plant cell and the plant cell regenerated into a whole, fertile or sterile plant. Exogenous genetic material is any genetic material, whether naturally occurring or otherwise, from any source that is capable of being inserted into any organism. Such genetic material may be transferred into either monocotyledons and dicotyledons including, but not limited to maize (pp 63-69), soybean (pp 50-60), *Arabidopsis* (p 45), *phaseolus* (pp 47-49), peanut (pp 49-50), alfalfa (p 60), wheat (pp 69-71), rice (pp 72-79), oat (pp 80-81), sorghum (p 83), rye (p 84), tritordeum (p 84), millet (p85), fescue (p 85), perennial ryegrass (p 86), sugarcane (p87), cranberry (p101), papaya (pp 101-102), banana (p 103), banana (p 103), muskmelon (p 104), apple (p 104), cucumber (p 105), dendrobium (p 109), gladiolus (p 110), chrysanthemum (p 110), liliacea (p 111), cotton (pp113-114), eucalyptus (p 115), sunflower (p 118), canola (p 118), turfgrass (p121), sugarbeet (p 122), coffee (p 122) and dioscorea (p 122), (Christou, In: *Particle Bombardment for Genetic Engineering of Plants*, Biotechnology Intelligence Unit, Academic Press, San Diego, Calif. (1996), the entirety of which is herein incorporated by reference).

Transfer of a nucleic acid that encodes for a protein can result in overexpression of that protein in a transformed cell or transgenic plant. One or more of the proteins or fragments thereof encoded by nucleic acid molecules of the present invention may be overexpressed in a transformed cell or transformed plant. Particularly, any of the sucrose pathway proteins or fragments thereof may be overexpressed in a transformed cell or transgenic plant. Such overexpression may be the result of transient or stable transfer of the exogenous genetic material.

Exogenous genetic material may be transferred into a plant cell and the plant cell by the use of a DNA vector or construct designed for such a purpose. Design of such a vector is generally within the skill of the art (See, *Plant Molecular Biology: A Laboratory Manual*, Clark (ed.), Springier, N.Y. (1997), the entirety of which is herein incorporated by reference).

A construct or vector may include a plant promoter to express the protein or protein fragment of choice. A number of promoters which are active in plant cells have been described in the literature. These include the nopaline synthase (NOS) promoter (Ebert et al., *Proc. Natl. Acad. Sci.* (U.S.A.) 84:5745-5749 (1987), the entirety of which is herein incorporated by reference), the octopine synthase (OCS) promoter (which are carried on tumor-inducing plasmids of *Agrobacterium tumefaciens*), the caulimovirus promoters such as the cauliflower mosaic virus (CaMV) 19S promoter (Lawton et al., *Plant Mol. Biol.* 9:315-324 (1987), the entirety of which is herein incorporated by reference) and the CAMV 35S promoter (Odell et al., *Nature* 313:810-812 (1985), the entirety of which is herein incorporated by reference), the figwort mosaic virus 35S-promoter, the light-inducible promoter from the small subunit of ribulose-1,5-bis-phosphate carboxylase (ssRUBISCO), the Adh promoter (Walker et al., *Proc. Natl. Acad. Sci.* (U.S.A.) 84:6624-6628 (1987), the entirety of which is herein incorporated by reference), the sucrose synthase promoter (Yang et al., *Proc. Natl. Acad. Sci.* (U.S.A.) 87:4144-4148 (1990), the entirety of which is herein incorporated by reference), the R gene complex promoter (Chandler et al., *The Plant Cell* 1:1175-1183 (1989), the entirety of which is herein incorporated by reference) and the chlorophyll a/b binding protein gene promoter, etc. These promoters have been used to create DNA constructs which have been expressed in plants; see, e.g., PCT publication WO 84/02913, herein incorporated by reference in its entirety.

Promoters which are known or are found to cause transcription of DNA in plant cells can be used in the present invention. Such promoters may be obtained from a variety of sources such as plants and plant viruses. It is preferred that the particular promoter selected should be capable of causing sufficient expression to result in the production of an effective amount of the sucrose pathway protein to cause the desired phenotype. In addition to promoters that are known to cause transcription of DNA in plant cells, other promoters may be identified for use in the current invention by screening a plant cDNA library for genes which are selectively or preferably expressed in the target tissues or cells.

For the purpose of expression in source tissues of the plant, such as the leaf, seed, root or stem, it is preferred that the promoters utilized in the present invention have relatively high expression in these specific tissues. For this purpose, one may choose from a number of promoters for genes with tissue- or cell-specific or -enhanced expression. Examples of such promoters reported in the literature include the chloroplast glutamine synthetase GS2 promoter from pea (Edwards et al., *Proc. Natl. Acad. Sci.* (U.S.A.) 87:3459-3463 (1990), herein incorporated by reference in its entirety), the chloroplast fructose-1,6-biphosphatase (FBPase) promoter from wheat (Lloyd et al., *Mol. Gen. Genet.* 225:209-216 (1991), herein incorporated by reference in its entirety), the nuclear photosynthetic ST-LS1 promoter from potato (Stockhaus et al., *EMBO J.* 8:2445-2451 (1989), herein incorporated by reference in its entirety), the serine/threonine kinase (PAL) promoter and the glucoamylase (CHS) promoter from *Arabidopsis thaliana*. Also reported to be active in photosynthetically active tissues are the ribulose-1,5-bisphosphate carboxylase (RbcS) promoter from eastern larch (*Larix laricina*), the promoter for the cab gene, cab6, from pine (Yamamoto et al., *Plant Cell Physiol.* 35:773-778 (1994), herein incorporated by reference in its entirety), the promoter for the Cab-1 gene from wheat (Fejes et al., *Plant Mol. Biol.* 15:921-932 (1990), herein incorporated by reference in its entirety), the promoter for the CAB-1 gene from spinach (Lubberstedt et al., *Plant Physiol.* 104:997-1006 (1994), herein incorporated by reference in its entirety), the promoter for the cab1R gene from rice (Luan et al., *Plant Cell.* 4:971-981 (1992), the entirety of which is herein incorporated by reference), the pyruvate, orthophosphate dikinase (PPDK) promoter from maize (Matsuoka et al., *Proc. Natl. Acad. Sci.* (U.S.A.) 90: 9586-9590 (1993), herein incorporated by reference in its entirety), the promoter for the tobacco Lhcb1*2 gene (Cerdan et al., *Plant Mol. Biol.* 33:245-255 (1997), herein incorporated by reference in its entirety), the *Arabidopsis thaliana* SUC2 sucrose-H+ symporter promoter (Truernit et al., *Planta.* 196:564-570 (1995), herein incorporated by reference in its entirety) and the promoter for the thylakoid membrane proteins from spinach (psaD, psaF, psaE, PC, FNR, atpC, atpD, cab, rbcS). Other promoters for the chlorophyll a/b-binding proteins may also be utilized in the present invention, such as the promoters for LhcB gene and PsbP gene from white mustard (*Sinapis alba*; Kretsch et al., *Plant Mol. Biol.* 28:219-229 (1995), the entirety of which is herein incorporated by reference).

For the purpose of expression in sink tissues of the plant, such as the tuber of the potato plant, the fruit of tomato, or the seed of maize, wheat, rice and barley, it is preferred that the promoters utilized in the present invention have relatively high expression in these specific tissues. A number of promoters for genes with tuber-specific or -enhanced expression are known, including the class I patatin promoter (Bevan et al., *EMBO J.* 8:1899-1906 (1986); Jefferson et al., *Plant Mol. Biol.* 14:995-1006 (1990), both of which are herein incorporated by reference in its entirety), the promoter for the potato tuber ADPGPP genes, both the large and small subunits, the sucrose synthase promoter (Salanoubat and Belliard, *Gene.* 60:47-56 (1987), Salanoubat and Belliard, *Gene.* 84:181-185 (1989), both of which are incorporated by reference in their entirety), the promoter for the major tuber proteins including the 22 kd protein complexes and proteinase inhibitors (Hannapel, *Plant Physiol.* 101:703-704 (1993), herein incorporated by reference in its entirety), the promoter for the granule bound starch synthase gene (GBSS) (Visser et al., *Plant Mol. Biol.* 17:691-699 (1991), herein incorporated by reference in its entirety) and other class I and II patatins promoters (Koster-Topfer et al., *Mol Gen Genet.* 219:390-396 (1989); Mignery et al., *Gene.* 62:27-44 (1988), both of which are herein incorporated by reference in their entirety).

Other promoters can also be used to express a sucrose pathway protein or fragment thereof in specific tissues, such as seeds or fruits. The promoter for β-conglycinin (Chen et al., *Dev. Genet.* 10: 112-122 (1989), herein incorporated by reference in its entirety) or other seed-specific promoters such as the napin and phaseolin promoters, can be used. The zeins are a group of storage proteins found in maize endosperm. Genomic clones for zein genes have been isolated (Pedersen et al., *Cell* 29:1015-1026 (1982), herein incorporated by reference in its entirety) and the promoters from these clones, including the 15 kD, 16 kD, 19 kD, 22 kD, 27 kD and genes, could also be used. Other promoters known to function, for example, in maize include the promoters for the following genes: waxy, Brittle, Shrunken 2, Branching enzymes I and II, starch synthases, debranching enzymes, oleosins, glutelins and sucrose synthases. A particularly preferred promoter for maize endosperm expression is the promoter for the glutelin gene from rice, more particularly the Osgt-1 promoter (Zheng et al., *Mol. Cell Biol.* 13:5829-5842 (1993), herein incorporated by reference in its entirety). Examples of promoters suitable for expression in wheat include those promoters for the ADPglucose pyrosynthase (ADPGPP) subunits, the granule bound and other starch synthase, the branching and debranching enzymes, the embryogenesis-abundant proteins, the gliadins and the glutenins. Examples of such promoters in rice include those promoters for the ADPGPP subunits, the granule bound and other starch synthase, the branching enzymes, the debranching enzymes, sucrose synthases and the glutelins. A particularly preferred promoter is the promoter for rice glutelin, Osgt-1. Examples of such promoters for barley include those for the ADPGPP subunits, the granule bound and other starch synthase, the branching enzymes, the debranching enzymes, sucrose synthases, the hordeins, the embryo globulins and the aleurone specific proteins.

Root specific promoters may also be used. An example of such a promoter is the promoter for the acid chitinase gene (Samac et al., *Plant Mol. Biol.* 25:587-596 (1994), the entirety of which is herein incorporated by reference). Expression in root tissue could also be accomplished by utilizing the root specific subdomains of the CaMV35S promoter that have been identified (Lam et al., *Proc. Natl. Acad. Sci.* (U.S.A.) 86:7890-7894 (1989), herein incorporated by reference in its entirety). Other root cell specific promoters include those reported by Conkling et al. (Conkling et al., *Plant Physiol.* 93:1203-1211 (1990), the entirety of which is herein incorporated by reference).

Additional promoters that may be utilized are described, for example, in U.S. Pat. Nos. 5,378,619; 5,391,725; 5,428,147; 5,447,858; 5,608,144; 5,608,144; 5,614,399; 5,633,441; 5,633,435; and 4,633,436, all of which are herein incorporated in their entirety. In addition, a tissue specific enhancer may be used (Fromm et al., *The Plant Cell* 1:977-984 (1989), the entirety of which is herein incorporated by reference).

Constructs or vectors may also include with the coding region of interest a nucleic acid sequence that acts, in whole or in part, to terminate transcription of that region. For example, such sequences have been isolated including the Tr7 3' sequence and the NOS 3' sequence (Ingelbrecht et al., *The Plant Cell* 1:671-680 (1989), the entirety of which is herein incorporated by reference; Bevan et al., *Nucleic Acids Res.* 11:369-385 (1983), the entirety of which is herein incorporated by reference), or the like.

A vector or construct may also include regulatory elements. Examples of such include the Adh intron 1 (Callis et al., *Genes and Develop.* 1:1183-1200 (1987), the entirety of which is herein incorporated by reference), the sucrose synthase intron (Vasil et al., Plant Physiol. 91:1575-1579 (1989), the entirety of which is herein incorporated by reference) and the TMV omega element (Gallie et al., *The Plant Cell* 1:301-311 (1989), the entirety of which is herein incorporated by reference). These and other regulatory elements may be included when appropriate.

A vector or construct may also include a selectable marker. Selectable markers may also be used to select for plants or plant cells that contain the exogenous genetic material. Examples of such include, but are not limited to, a neo gene (Potrykus et al., *Mol. Gen. Genet.* 199:183-188 (1985), the entirety of which is herein incorporated by reference) which codes for kanamycin resistance and can be selected for using kanamycin, G418, etc.; a bar gene which codes for bialaphos resistance; a mutant EPSP synthase gene (Hinchee et al., *Bio/Technology* 6:915-922 (1988), the entirety of which is herein incorporated by reference) which encodes glyphosate resistance; a nitrilase gene which confers resistance to bromoxynil (Stalker et al., *J. Biol. Chem.* 263:6310-6314 (1988), the entirety of which is herein incorporated by reference); a mutant acetolactate synthase gene (ALS) which confers imidazolinone or sulphonylurea resistance (European Patent Application 154,204 (Sep. 11, 1985), the entirety of which is herein incorporated by reference); and a methotrexate resistant DHFR gene (Thillet et al., *J. Biol. Chem.* 263:12500-12508 (1988), the entirety of which is herein incorporated by reference).

A vector or construct may also include a transit peptide. Incorporation of a suitable chloroplast transit peptide may also be employed (European Patent Application Publication Number 0218571, the entirety of which is herein incorporated by reference). Translational enhancers may also be incorporated as part of the vector DNA. DNA constructs could contain one or more 5' non-translated leader sequences which may serve to enhance expression of the gene products from the resulting mRNA transcripts. Such sequences may be derived from the promoter selected to express the gene or can be specifically modified to increase translation of the mRNA. Such regions may also be obtained from viral RNAs, from suitable eukaryotic genes, or from a synthetic gene sequence. For a review of optimizing expression of transgenes, see Koziel et al., *Plant Mol. Biol.* 32:393-405 (1996), the entirety of which is herein incorporated by reference.

A vector or construct may also include a screenable marker. Screenable markers may be used to monitor expression. Exemplary screenable markers include a β-glucuronidase or uidA gene (GUS) which encodes an enzyme for which various chromogenic substrates are known (Jefferson, *Plant Mol. Biol, Rep.* 5:387-405 (1987), the entirety of which is herein incorporated by reference; Jefferson et al., *EMBO J.* 6:3901-3907 (1987), the entirety of which is herein incorporated by reference); an R-locus gene, which encodes a product that regulates the production of anthocyanin pigments (red color) in plant tissues (Dellaporta et al., Stadler Symposium 11:263-282 (1988), the entirety of which is herein incorporated by reference); a β-lactamase gene (Sutcliffe et al., *Proc. Natl. Acad. Sci.* (U.S.A.) 75:3737-3741 (1978), the entirety of which is herein incorporated by reference), a gene which encodes an enzyme for which various chromogenic substrates are known (e.g., PADAC, a chromogenic cephalosporin); a luciferase gene (Ow et al., *Science* 234:856-859 (1986), the entirety of which is herein incorporated by reference); a xylE gene (Zukowsky et al., *Proc. Natl. Acad. Sci.* (U.S.A.) 80:1101-1105 (1983), the entirety of which is herein incorporated by reference) which encodes a catechol diozygenase that can convert chromogenic catechols; an α-amylase gene (Ikatu et al., *Bio/Technol.* 8:241-242 (1990), the entirety of which is herein incorporated by reference); a tyrosinase gene (Katz et al., *J. Gen. Microbiol.* 129:2703-2714 (1983), the entirety of which is herein incorporated by reference) which encodes an enzyme capable of oxidizing tyrosine to DOPA and dopaquinone which in turn condenses to melanin; an α-galactosidase, which will turn a chromogenic α-galactose substrate.

Included within the terms "selectable or screenable marker genes" are also genes which encode a secretable marker whose secretion can be detected as a means of identifying or selecting for transformed cells. Examples include markers which encode a secretable antigen that can be identified by antibody interaction, or even secretable enzymes which can be detected catalytically. Secretable proteins fall into a number of classes, including small, diffusible proteins which are detectable, (e.g., by ELISA), small active enzymes which are detectable in extracellular solution (e.g. α-amylase, β-lactamase, phosphinothricin transferase), or proteins which are inserted or trapped in the cell wall (such as proteins which include a leader sequence such as that found in the expression unit of extension or tobacco PR-S). Other possible selectable and/or screenable marker genes will be apparent to those of skill in the art.

There are many methods for introducing transforming nucleic acid molecules into plant cells. Suitable methods are believed to include virtually any method by which nucleic acid molecules may be introduced into a cell, such as by *Agrobacterium* infection or direct delivery of nucleic acid molecules such as, for example, by PEG-mediated transformation, by electroporation or by acceleration of DNA coated particles, etc (Potrykus, *Ann. Rev. Plant Physiol. Plant Mol. Biol.* 42:205-225 (1991), the entirety of which is herein incorporated by reference; Vasil, *Plant Mol. Biol.* 25:925-937 (1994), the entirety of which is herein incorporated by reference). For example, electroporation has been used to transform maize protoplasts (Fromm et al., *Nature* 312:791-793 (1986), the entirety of which is herein incorporated by reference).

Other vector systems suitable for introducing transforming DNA into a host plant cell include but are not limited to binary artificial chromosome (BIBAC) vectors (Hamilton et al., *Gene* 200:107-116 (1997), the entirety of which is herein incorporated by reference); and transfection with RNA viral vectors (Della-Cioppa et al., *Ann. N.Y. Acad. Sci.* (1996), 792 (Engineering Plants for Commercial Products and Applications), 57-61, the entirety of which is herein incorporated by reference). Additional vector systems also include plant selectable YAC vectors such as those described in Mullen et al., *Molecular Breeding* 4:449-457 (1988), the entireity of which is herein incorporated by reference).

Technology for introduction of DNA into cells is well known to those of skill in the art. Four general methods for delivering a gene into cells have been described: (1) chemical methods (Graham and van der Eb, *Virology* 54:536-539 (1973), the entirety of which is herein incorporated by reference); (2) physical methods such as microinjection (Capecchi, *Cell* 22:479-488 (1980), the entirety of which is herein incorporated by reference), electroporation (Wong and Neumann, *Biochem. Biophys. Res. Commun.* 107:584-587 (1982); Fromm et al., *Proc. Natl. Acad. Sci.* (U.S.A.) 82:5824-5828 (1985); U.S. Pat. No. 5,384,253, all of which are herein incorporated in their entirety); and the gene gun (Johnston and Tang, *Methods Cell Biol.* 43:353-365 (1994), the entirety of which is herein incorporated by reference); (3) viral vectors (Clapp, *Clin. Perinatol.* 20:155-168 (1993); Lu et al., *J. Exp. Med.* 178:2089-2096 (1993); Eglitis and Anderson, *Biotechniques* 6:608-614 (1988), all of which are herein incorporated in their entirety); and (4) receptor-mediated mechanisms (Curiel et al., *Hum. Gen. Ther.* 3:147-154 (1992), Wagner et al., *Proc. Natl. Acad. Sci.* (*USA*) 89:6099-6103 (1992), both of which are incorporated by reference in their entirety).

Acceleration methods that may be used include, for example, microprojectile bombardment and the like. One example of a method for delivering transforming nucleic acid molecules to plant cells is microprojectile bombardment. This method has been reviewed by Yang and Christou (eds.), *Particle Bombardment Technology for Gene Transfer*, Oxford Press, Oxford, England (1994), the entirety of which is herein incorporated by reference). Non-biological particles (microprojectiles) that may be coated with nucleic acids and delivered into cells by a propelling force. Exemplary particles include those comprised of tungsten, gold, platinum and the like.

A particular advantage of microprojectile bombardment, in addition to it being an effective means of reproducibly transforming monocots, is that neither the isolation of protoplasts (Cristou et al., *Plant Physiol.* 87:671-674 (1988), the entirety of which is herein incorporated by reference) nor the susceptibility of *Agrobacterium* infection are required. An illustrative embodiment of a method for delivering DNA into maize cells by acceleration is a biolistics α-particle delivery system, which can be used to propel particles coated with DNA through a screen, such as a stainless steel or Nytex screen, onto a filter surface covered with corn cells cultured in suspension. Gordon-Kamm et al., describes the basic procedure for coating tungsten particles with DNA (Gordon-Kamm et al., *Plant Cell* 2:603-618 (1990), the entirety of which is herein incorporated by reference). The screen disperses the tungsten nucleic acid particles so that they are not delivered to the recipient cells in large aggregates. A particle delivery system suitable for use with the present invention is the helium acceleration PDS-1000/He gun is available from Bio-Rad Laboratories (Bio-Rad, Hercules, Calif.)(Sanford et al., *Technique* 3:3-16 (1991), the entirety of which is herein incorporated by reference).

For the bombardment, cells in suspension may be concentrated on filters. Filters containing the cells to be bombarded are positioned at an appropriate distance below the microprojectile stopping plate. If desired, one or more screens are also positioned between the gun and the cells to be bombarded.

Alternatively, immature embryos or other target cells may be arranged on solid culture medium. The cells to be bombarded are positioned at an appropriate distance below the microprojectile stopping plate. If desired, one or more screens are also positioned between the acceleration device and the cells to be bombarded. Through the use of techniques set forth herein one may obtain up to 1000 or more foci of cells transiently expressing a marker gene. The number of cells in a focus which express the exogenous gene product 48 hours post-bombardment often range from one to ten and average one to three.

In bombardment transformation, one may optimize the pre-bombardment culturing conditions and the bombardment parameters to yield the maximum numbers of stable transformants. Both the physical and biological parameters for bombardment are important in this technology. Physical factors are those that involve manipulating the DNA/microprojectile precipitate or those that affect the flight and velocity of either the macro- or microprojectiles. Biological factors include all steps involved in manipulation of cells before and immediately after bombardment, the osmotic adjustment of target cells to help alleviate the trauma associated with bombardment and also the nature of the transforming DNA, such as linearized DNA or intact supercoiled plasmids. It is believed that pre-bombardment manipulations are especially important for successful transformation of immature embryos.

In another alternative embodiment, plastids can be stably transformed. Methods disclosed for plastid transformation in higher plants include the particle gun delivery of DNA containing a selectable marker and targeting of the DNA to the plastid genome through homologous recombination (Svab et al., *Proc. Natl. Acad. Sci.* (U.S.A.) 87:8526-8530 (1990); Svab and Maliga, *Proc. Natl. Acad. Sci.* (U.S.A.) 90:913-917 (1993); Staub and Maliga, *EMBO J.* 12:601-606 (1993); U.S. Pat. Nos. 5,451,513 and 5,545,818, all of which are herein incorporated by reference in their entirety).

Accordingly, it is contemplated that one may wish to adjust various aspects of the bombardment parameters in small scale studies to fully optimize the conditions. One may particularly wish to adjust physical parameters such as gap distance, flight distance, tissue distance and helium pressure. One may also minimize the trauma reduction factors by modifying conditions which influence the physiological state of the recipient cells and which may therefore influence transformation and integration efficiencies. For example, the osmotic state, tissue hydration and the subculture stage or cell cycle of the recipient cells may be adjusted for optimum transformation. The execution of other routine adjustments will be known to those of skill in the art in light of the present disclosure.

Agrobacterium-mediated transfer is a widely applicable system for introducing genes into plant cells because the DNA can be introduced into whole plant tissues, thereby bypassing the need for regeneration of an intact plant from a protoplast. The use of Agrobacterium-mediated plant integrating vectors to introduce DNA into plant cells is well known in the art. See, for example the methods described by Fraley et al., Bio/Technology 3:629-635 (1985) and Rogers et al., Methods Enzymol. 153:253-277 (1987), both of which are herein incorporated by reference in their entirety. Further, the integration of the Ti-DNA is a relatively precise process resulting in few rearrangements. The region of DNA to be transferred is defined by the border sequences and intervening DNA is usually inserted into the plant genome as described (Spielmann et al., Mol. Gen. Genet. 205:34 (1986), the entirety of which is herein incorporated by reference).

Modern Agrobacterium transformation vectors are capable of replication in E. coli as well as Agrobacterium, allowing for convenient manipulations as described (Klee et al., In: Plant DNA Infectious Agents, Hohn and Schell (eds.), Springer-Verlag, New York, pp. 179-203 (1985), the entirety of which is herein incorporated by reference. Moreover, technological advances in vectors for Agrobacterium-mediated gene transfer have improved the arrangement of genes and restriction sites in the vectors to facilitate construction of vectors capable of expressing various polypeptide coding genes. The vectors described have convenient multi-linker regions flanked by a promoter and a polyadenylation site for direct expression of inserted polypeptide coding genes and are suitable for present purposes (Rogers et al., Methods Enzymol. 153:253-277 (1987)). In addition, Agrobacterium containing both armed and disarmed Ti genes can be used for the transformations. In those plant strains where Agrobacterium-mediated transformation is efficient, it is the method of choice because of the facile and defined nature of the gene transfer.

A transgenic plant formed using Agrobacterium transformation methods typically contains a single gene on one chromosome. Such transgenic plants can be referred to as being heterozygous for the added gene. More preferred is a transgenic plant that is homozygous for the added structural gene; i.e., a transgenic plant that contains two added genes, one gene at the same locus on each chromosome of a chromosome pair. A homozygous transgenic plant can be obtained by sexually mating (selfing) an independent segregant transgenic plant that contains a single added gene, germinating some of the seed produced and analyzing the resulting plants produced for the gene of interest.

It is also to be understood that two different transgenic plants can also be mated to produce offspring that contain two independently segregating added, exogenous genes. Selfing of appropriate progeny can produce plants that are homozygous for both added, exogenous genes that encode a polypeptide of interest. Back-crossing to a parental plant and out-crossing with a non-transgenic plant are also contemplated, as is vegetative propagation.

Transformation of plant protoplasts can be achieved using methods based on calcium phosphate precipitation, polyethylene glycol treatment, electroporation and combinations of these treatments (See, for example, Potrykus et al., Mol. Gen. Genet. 205:193-200 (1986); Lorz et al., Mol. Gen. Genet. 199:178 (1985); Fromm et al., Nature 319:791 (1986); Uchimiya et al., Mol. Gen. Genet. 204:204 (1986); Marcotte et al., Nature 335:454-457 (1988), all of which are herein incorporated by reference in their entirety).

Application of these systems to different plant strains depends upon the ability to regenerate that particular plant strain from protoplasts. Illustrative methods for the regeneration of cereals from protoplasts are described (Fujimura et al., Plant Tissue Culture Letters 2:74 (1985); Toriyama et al., Theor Appl. Genet. 205:34 (1986); Yamada et al., Plant Cell Rep. 4:85 (1986); Abdullah et al., Biotechnolog 4:1087 (1986), all of which are herein incorporated by reference in their entirety).

To transform plant strains that cannot be successfully regenerated from protoplasts, other ways to introduce DNA into intact cells or tissues can be utilized. For example, regeneration of cereals from immature embryos or explants can be effected as described (Vasil, Biotechnology 6:397 (1988), the entirety of which is herein incorporated by reference). In addition, "particle gun" or high-velocity microprojectile technology can be utilized (Vasil et al., Bio/Technology 10:667 (1992), the entirety of which is herein incorporated by reference).

Using the latter technology, DNA is carried through the cell wall and into the cytoplasm on the surface of small metal particles as described (Klein et al., Nature 328:70 (1987); Klein et al., Proc. Natl. Acad. Sci. (U.S.A.) 85:8502-8505 (1988); McCabe et al., Bio/Technology 6:923 (1988), all of which are herein incorporated by reference in their entirety). The metal particles penetrate through several layers of cells and thus allow the transformation of cells within tissue explants.

Other methods of cell transformation can also be used and include but are not limited to introduction of DNA into plants by direct DNA transfer into pollen (Zhou et al., Methods Enzymol. 101:433 (1983); Hess et al, Intern Rev. Cytol. 107: 367 (1987); Luo et al., Plant Mol Biol. Reporter 6:165 (1988), all of which are herein incorporated by reference in their entirety), by direct injection of DNA into reproductive organs of a plant (Pena et al., Nature 325:274 (1987), the entirety of which is herein incorporated by reference), or by direct injection of DNA into the cells of immature embryos followed by the rehydration of desiccated embryos (Neuhaus et al., Theor. Appl. Genet. 75:30 (1987), the entirety of which is herein incorporated by reference).

The regeneration, development and cultivation of plants from single plant protoplast transformants or from various transformed explants is well known in the art (Weissbach and Weissbach, In: Methods for Plant Molecular Biology, Academic Press, San Diego, Calif., (1988), the entirety of which is herein incorporated by reference). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil.

The development or regeneration of plants containing the foreign, exogenous gene that encodes a protein of interest is well known in the art. Preferably, the regenerated plants are self-pollinated to provide homozygous transgenic plants.

Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

There are a variety of methods for the regeneration of plants from plant tissue. The particular method of regeneration will depend on the starting plant tissue and the particular plant species to be regenerated.

Methods for transforming dicots, primarily by use of *Agrobacterium tumefaciens* and obtaining transgenic plants have been published for cotton (U.S. Pat. Nos. 5,004,863; 5,159,135; 5,518,908, all of which are herein incorporated by reference in their entirety); soybean (U.S. Pat. Nos. 5,569,834; 5,416,011; McCabe et. al., *Biotechnology* 6:923 (1988); Christou et al., *Plant Physiol*. 87:671-674 (1988); all of which are herein incorporated by reference in their entirety); Brassica (U.S. Pat. No. 5,463,174, the entirety of which is herein incorporated by reference); peanut (Cheng et al., *Plant Cell Rep*. 15:653-657 (1996), McKently et al., *Plant Cell Rep*. 14:699-703 (1995), all of which are herein incorporated by reference in their entirety); papaya; and pea (Grant et al., *Plant Cell Rep*. 15:254-258 (1995), the entirety of which is herein incorporated by reference).

Transformation of monocotyledons using electroporation, particle bombardment and *Agrobacterium* have also been reported. Transformation and plant regeneration have been achieved in asparagus (Bytebier et al., *Proc. Natl. Acad. Sci. (USA)* 84:5354 (1987), the entirety of which is herein incorporated by reference); barley (Wan and Lemaux, *Plant Physiol* 104:37 (1994), the entirety of which is herein incorporated by reference); maize (Rhodes et al., *Science* 240:204 (1988); Gordon-Kamm et al., *Plant Cell* 2:603-618 (1990); Fromm et al., *Bio/Technology* 8:833 (1990); Koziel et al., *Bio/Technology* 11:194 (1993); Armstrong et al., *Crop Science* 35:550-557 (1995); all of which are herein incorporated by reference in their entirety); oat (Somers et al., *Bio/Technology* 10:1589 (1992), the entirety of which is herein incorporated by reference); orchard grass (Horn et al., *Plant Cell Rep*. 7:469 (1988), the entirety of which is herein incorporated by reference); rice (Toriyama et al., *Theor Appl. Genet*. 205:34 (1986); Part et al., *Plant Mol. Biol*. 32:1135-1148 (1996); Abedinia et al., *Aust. J. Plant Physiol*. 24:133-141 (1997); Zhang and Wu, *Theor. Appl. Genet*. 76:835 (1988); Zhang et al., *Plant Cell Rep*. 7:379 (1988); Battraw and Hall, *Plant Sci*. 86:191-202 (1992); Christou et al., *Bio/Technology* 9:957 (1991), all of which are herein incorporated by reference in their entirety); rye (De la Pena et al., *Nature* 325:274 (1987), the entirety of which is herein incorporated by reference); sugarcane (Bower and Birch, *Plant J*. 2:409 (1992), the entirety of which is herein incorporated by reference); tall fescue (Wang et al., *Bio/Technology* 10:691 (1992), the entirety of which is herein incorporated by reference) and wheat (Vasil et al., *Bio/Technology* 10:667 (1992), the entirety of which is herein incorporated by reference; U.S. Pat. No. 5,631,152, the entirety of which is herein incorporated by reference.)

Assays for gene expression based on the transient expression of cloned nucleic acid constructs have been developed by introducing the nucleic acid molecules into plant cells by polyethylene glycol treatment, electroporation, or particle bombardment (Marcotte et al., *Nature* 335:454-457 (1988), the entirety of which is herein incorporated by reference; Marcotte et al., *Plant Cell* 1:523-532 (1989), the entirety of which is herein incorporated by reference; McCarty et al., *Cell* 66:895-905 (1991), the entirety of which is herein incorporated by reference; Hattori et al., *Genes Dev*. 6:609-618 (1992), the entirety of which is herein incorporated by reference; Goff et al., *EMBO J*. 9:2517-2522 (1990), the entirety of which is herein incorporated by reference). Transient expression systems may be used to functionally dissect gene constructs (see generally, Mailga et al., *Methods in Plant Molecular Biology*, Cold Spring Harbor Press (1995)).

Any of the nucleic acid molecules of the present invention may be introduced into a plant cell in a permanent or transient manner in combination with other genetic elements such as vectors, promoters, enhancers etc. Further, any of the nucleic acid molecules of the present invention may be introduced into a plant cell in a manner that allows for overexpression of the protein or fragment thereof encoded by the nucleic acid molecule.

Cosuppression is the reduction in expression levels, usually at the level of RNA, of a particular endogenous gene or gene family by the expression of a homologous sense construct that is capable of transcribing mRNA of the same strandedness as the transcript of the endogenous gene (Napoli et al., *Plant Cell* 2:279-289 (1990), the entirety of which is herein incorporated by reference; van der Krol et al., *Plant Cell* 2:291-299 (1990), the entirety of which is herein incorporated by reference). Cosuppression may result from stable transformation with a single copy nucleic acid molecule that is homologous to a nucleic acid sequence found with the cell (Prolls and Meyer, *Plant J*. 2:465-475 (1992), the entirety of which is herein incorporated by reference) or with multiple copies of a nucleic acid molecule that is homologous to a nucleic acid sequence found with the cell (Mittlesten et al., *Mol. Gen. Genet*. 244:325-330 (1994), the entirety of which is herein incorporated by reference). Genes, even though different, linked to homologous promoters may result in the cosuppression of the linked genes (Vaucheret, C. R. *Acad. Sci. III* 316:1471-1483 (1993), the entirety of which is herein incorporated by reference).

This technique has, for example, been applied to generate white flowers from red petunia and tomatoes that do not ripen on the vine. Up to 50% of petunia transformants that contained a sense copy of the glucoamylase (CHS) gene produced white flowers or floral sectors; this was as a result of the post-transcriptional loss of mRNA encoding CHS (Flavell, *Proc. Natl. Acad. Sci.* (U.S.A.) 91:3490-3496 (1994), the entirety of which is herein incorporated by reference); van Blokland et al., *Plant J*. 6:861-877 (1994), the entirety of which is herein incorporated by reference). Cosuppression may require the coordinate transcription of the transgene and the endogenous gene and can be reset by a developmental control mechanism (Jorgensen, *Trends Biotechnol*. 8:340-344 (1990), the entirety of which is herein incorporated by reference; Meins and Kunz, In: *Gene Inactivation and Homologous Recombination in Plants*, Paszkowski (ed.), pp. 335-348, Kluwer Academic, Netherlands (1994), the entirety of which is herein incorporated by reference).

It is understood that one or more of the nucleic acids of the present invention may be introduced into a plant cell and transcribed using an appropriate promoter with such transcription resulting in the cosuppression of an endogenous sucrose pathway protein.

Antisense approaches are a way of preventing or reducing gene function by targeting the genetic material (Mol et al., *FEBS Lett*. 268:427-430 (1990), the entirety of which is herein incorporated by reference). The objective of the antisense approach is to use a sequence complementary to the target gene to block its expression and create a mutant cell line or organism in which the level of a single chosen protein is selectively reduced or abolished. Antisense techniques have several advantages over other 'reverse genetic' approaches. The site of inactivation and its developmental effect can be manipulated by the choice of promoter for antisense genes or by the timing of external application or microinjection. Antisense can manipulate its specificity by selecting either unique regions of the target gene or regions where it shares homology to other related genes (Hiatt et al., In: *Genetic Engineering*, Setlow (ed.), Vol. 11, New York: Plenum 49-63 (1989), the entirety of which is herein incorporated by reference).

The principle of regulation by antisense RNA is that RNA that is complementary to the target mRNA is introduced into cells, resulting in specific RNA:RNA duplexes being formed by base pairing between the antisense substrate and the target mRNA (Green et al., *Annu. Rev. Biochem.* 55:569-597 (1986), the entirety of which is herein incorporated by reference). Under one embodiment, the process involves the introduction and expression of an antisense gene sequence. Such a sequence is one in which part or all of the normal gene sequences are placed under a promoter in inverted orientation so that the 'wrong' or complementary strand is transcribed into a noncoding antisense RNA that hybridizes with the target mRNA and interferes with its expression (Takayama and Inouye, *Crit. Rev. Biochem. Mol. Biol.* 25:155-184 (1990), the entirety of which is herein incorporated by reference). An antisense vector is constructed by standard procedures and introduced into cells by transformation, transfection, electroporation, microinjection, infection, etc. The type of transformation and choice of vector will determine whether expression is transient or stable. The promoter used for the antisense gene may influence the level, timing, tissue, specificity, or inducibility of the antisense inhibition.

It is understood that the activity of a sucrose pathway protein in a plant cell may be reduced or depressed by growing a transformed plant cell containing a nucleic acid molecule whose non-transcribed strand encodes a sucrose pathway protein or fragment thereof.

Antibodies have been expressed in plants (Hiatt et al., *Nature* 342:76-78 (1989), the entirety of which is herein incorporated by reference; Conrad and Fielder, *Plant Mol. Biol.* 26:1023-1030 (1994), the entirety of which is herein incorporated by reference). Cytoplamsic expression of a scFv (single-chain Fv antibodies) has been reported to delay infection by artichoke mottled crinkle virus. Transgenic plants that express antibodies directed against endogenous proteins may exhibit a physiological effect (Philips et al., *EMBO J.* 16:4489-4496 (1997), the entirety of which is herein incorporated by reference; Marion-Poll, *Trends in Plant Science* 2:447-448 (1997), the entirety of which is herein incorporated by reference). For example, expressed anti-abscisic antibodies have been reported to result in a general perturbation of seed development (Philips et al., *EMBO J.* 16: 4489-4496 (1997)).

Antibodies that are catalytic may also be expressed in plants (abzymes). The principle behind abzymes is that since antibodies may be raised against many molecules, this recognition ability can be directed toward generating antibodies that bind transition states to force a chemical reaction forward (Persidas, *Nature Biotechnology* 15:1313-1315 (1997), the entirety of which is herein incorporated by reference; Baca et al., *Ann. Rev. Biophys. Biomol. Struct.* 26:461-493 (1997), the entirety of which is herein incorporated by reference). The catalytic abilities of abzymes may be enhanced by site directed mutagenesis. Examples of abzymes are, for example, set forth in U.S. Pat. Nos: 5,658,753; 5,632,990; 5,631,137; 5,602,015; 5,559,538; 5,576,174; 5,500,358; 5,318,897; 5,298,409; 5,258,289 and 5,194,585, all of which are herein incorporated in their entirety.

It is understood that any of the antibodies of the present invention may be expressed in plants and that such expression can result in a physiological effect. It is also understood that any of the expressed antibodies may be catalytic.

(b) Fungal Constructs and Fungal Transformants

The present invention also relates to a fungal recombinant vector comprising exogenous genetic material. The present invention also relates to a fungal cell comprising a fungal recombinant vector. The present invention also relates to methods for obtaining a recombinant fungal host cell comprising introducing into a fungal host cell exogenous genetic material.

Exogenous genetic material may be transferred into a fungal cell. In a preferred embodiment the exogenous genetic material includes a nucleic acid molecule of the present invention having a sequence selected from the group consisting of SEQ ID NO: 1 through SEQ ID NO: 2814 or complements thereof or fragments of either or other nucleic acid molecule of the present invention. The fungal recombinant vector may be any vector which can be conveniently subjected to recombinant DNA procedures. The choice of a vector will typically depend on the compatibility of the vector with the fungal host cell into which the vector is to be introduced. The vector may be a linear or a closed circular plasmid. The vector system may be a single vector or plasmid or two or more vectors or plasmids which together contain the total DNA to be introduced into the genome of the fungal host.

The fungal vector may be an autonomously replicating vector, i.e., a vector which exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the fungal cell, is integrated into the genome and replicated together with the chromosome(s) into which it has been integrated. For integration, the vector may rely on the nucleic acid sequence of the vector for stable integration of the vector into the genome by homologous or nonhomologous recombination. Alternatively, the vector may contain additional nucleic acid sequences for directing integration by homologous recombination into the genome of the fungal host. The additional nucleic acid sequences enable the vector to be integrated into the host cell genome at a precise location(s) in the chromosome(s). To increase the likelihood of integration at a precise location, there should be preferably two nucleic acid sequences which individually contain a sufficient number of nucleic acids, preferably 400 bp to 1500 bp, more preferably 800 bp to 1000 bp, which are highly homologous with the corresponding target sequence to enhance the probability of homologous recombination. These nucleic acid sequences may be any sequence that is homologous with a target sequence in the genome of the fungal host cell and, furthermore, may be non-encoding or encoding sequences.

For autonomous replication, the vector may further comprise an origin of replication enabling the vector to replicate autonomously in the host cell in question. Examples of origin of replications for use in a yeast host cell are the 2 micron origin of replication and the combination of CEN3 and ARS 1. Any origin of replication may be used which is compatible with the fungal host cell of choice.

The fungal vectors of the present invention preferably contain one or more selectable markers which permit easy selection of transformed cells. A selectable marker is a gene the product of which provides, for example biocide or viral resistance, resistance to heavy metals, prototrophy to auxotrophs and the like. The selectable marker may be selected from the group including, but not limited to, amdS (acetamidase), argB (ornithine carbamoyltransferase), bar (phosphinothricin acetyltransferase), hygB (hygromycin phosphotransferase), niaD (nitrate reductase), pyrG (orotidine-5'-phosphate decarboxylase) and sC (sulfate adenyltransferase) and trpC (anthranilate synthase). Preferred for use in an *Aspergillus* cell are the amdS and pyrG markers of *Aspergillus nidulans* or *Aspergillus oryzae* and the bar marker of *Streptomyces hygroscopicus*. Furthermore, selection may be accomplished by co-transformation, e.g., as described in WO 91/17243, the entirety of which is herein incorporated by reference. A nucleic acid sequence of the present invention may be operably linked to a suitable promoter sequence. The promoter sequence is a nucleic acid sequence which is recognized by the fungal host cell for expression of the nucleic acid sequence. The promoter sequence contains transcription and translation control sequences which mediate the expression of the protein or fragment thereof.

A promoter may be any nucleic acid sequence which shows transcriptional activity in the fungal host cell of choice and may be obtained from genes encoding polypeptides either homologous or heterologous to the host cell. Examples of suitable promoters for directing the transcription of a nucleic acid construct of the invention in a filamentous fungal host are promoters obtained from the genes encoding *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase and hybrids thereof. In a yeast host, a useful promoter is the *Saccharomyces cerevisiae* enolase (eno-1) promoter. Particularly preferred promoters are the TAKA amylase, NA2-tpi (a hybrid of the promoters from the genes encoding *Aspergillus niger* neutral alpha-amylase and *Aspergillus oryzae* triose phosphate isomerase) and glaA promoters.

A protein or fragment thereof encoding nucleic acid molecule of the present invention may also be operably linked to a terminator sequence at its 3' terminus. The terminator sequence may be native to the nucleic acid sequence encoding the protein or fragment thereof or may be obtained from foreign sources. Any terminator which is functional in the fungal host cell of choice may be used in the present invention, but particularly preferred terminators are obtained from the genes encoding *Aspergillus oryzae* TAKA amylase, *Aspergillus niger* glucoamylase, *Aspergillus nidulans* anthranilate synthase, *Aspergillus niger* alpha-glucosidase and *Saccharomyces cerevisiae* enolase.

A protein or fragment thereof encoding nucleic acid molecule of the present invention may also be operably linked to a suitable leader sequence. A leader sequence is a nontranslated region of a mRNA which is important for translation by the fungal host. The leader sequence is operably linked to the 5' terminus of the nucleic acid sequence encoding the protein or fragment thereof. The leader sequence may be native to the nucleic acid sequence encoding the protein or fragment thereof or may be obtained from foreign sources. Any leader sequence which is functional in the fungal host cell of choice may be used in the present invention, but particularly preferred leaders are obtained from the genes encoding *Aspergillus oryzae* TAKA amylase and *Aspergillus oryzae* triose phosphate isomerase.

A polyadenylation sequence may also be operably linked to the 3' terminus of the nucleic acid sequence of the present invention. The polyadenylation sequence is a sequence which when transcribed is recognized by the fungal host to add polyadenosine residues to transcribed mRNA. The polyadenylation sequence may be native to the nucleic acid sequence encoding the protein or fragment thereof or may be obtained from foreign sources. Any polyadenylation sequence which is functional in the fungal host of choice may be used in the present invention, but particularly preferred polyadenylation sequences are obtained from the genes encoding *Aspergillus oryzae* TAKA amylase, *Aspergillus niger* glucoamylase, *Aspergillus nidulans* anthranilate synthase and *Aspergillus niger* alpha-glucosidase.

To avoid the necessity of disrupting the cell to obtain the protein or fragment thereof and to minimize the amount of possible degradation of the expressed protein or fragment thereof within the cell, it is preferred that expression of the protein or fragment thereof gives rise to a product secreted outside the cell. To this end, a protein or fragment thereof of the present invention may be linked to a signal peptide linked to the amino terminus of the protein or fragment thereof. A signal peptide is an amino acid sequence which permits the secretion of the protein or fragment thereof from the fungal host into the culture medium. The signal peptide may be native to the protein or fragment thereof of the invention or may be obtained from foreign sources. The 5' end of the coding sequence of the nucleic acid sequence of the present invention may inherently contain a signal peptide coding region naturally linked in translation reading frame with the segment of the coding region which encodes the secreted protein or fragment thereof. Alternatively, the 5' end of the coding sequence may contain a signal peptide coding region which is foreign to that portion of the coding sequence which encodes the secreted protein or fragment thereof. The foreign signal peptide may be required where the coding sequence does not normally contain a signal peptide coding region. Alternatively, the foreign signal peptide may simply replace the natural signal peptide to obtain enhanced secretion of the desired protein or fragment thereof. The foreign signal peptide coding region may be obtained from a glucoamylase or an amylase gene from an *Aspergillus* species, a lipase or proteinase gene from *Rhizomucor miehei*, the gene for the alpha-factor from *Saccharomyces cerevisiae*, or the calf preprochymosin gene. An effective signal peptide for fungal host cells is the *Aspergillus oryzae* TAKA amylase signal, *Aspergillus niger* neutral amylase signal, the *Rhizomucor miehei* aspartic proteinase signal, the *Humicola lanuginosus* cellulase signal, or the *Rhizomucor miehei* lipase signal. However, any signal peptide capable of permitting secretion of the protein or fragment thereof in a fungal host of choice may be used in the present invention.

A protein or fragment thereof encoding nucleic acid molecule of the present invention may also be linked to a propeptide coding region. A propeptide is an amino acid sequence found at the amino terminus of a proprotein or proenzyme. Cleavage of the propeptide from the proprotein yields a mature biochemically active protein. The resulting polypeptide is known as a propolypeptide or proenzyme (or a zymogen in some cases). Propolypeptides are generally inactive and can be converted to mature active polypeptides by catalytic or autocatalytic cleavage of the propeptide from the propolypeptide or proenzyme. The propeptide coding region may be native to the protein or fragment thereof or may be obtained from foreign sources. The foreign propeptide coding region may be obtained from the *Saccharomyces cerevisiae* alpha-factor gene or *Myceliophthora thermophila* laccase gene (WO 95/33836, the entirety of which is herein incorporated by reference).

The procedures used to ligate the elements described above to construct the recombinant expression vector of the present invention are well known to one skilled in the art (see, for example, Sambrook et al., *Molecular Cloning, A Laboratory Manual*, 2nd ed., Cold Spring Harbor, N.Y., (1989)).

The present invention also relates to recombinant fungal host cells produced by the methods of the present invention which are advantageously used with the recombinant vector of the present invention. The cell is preferably transformed with a vector comprising a nucleic acid sequence of the invention followed by integration of the vector into the host chromosome. The choice of fungal host cells will to a large extent depend upon the gene encoding the protein or fragment thereof and its source. The fungal host cell may, for example, be a yeast cell or a filamentous fungal cell.

"Yeast" as used herein includes Ascosporogenous yeast (Endomycetales), Basidiosporogenous yeast and yeast belonging to the Fungi Imperfecti (Blastomycetes). The Ascosporogenous yeasts are divided into the families Spermophthoraceae and Saccharomycetaceae. The latter is comprised of four subfamilies, Schizosaccharomycoideae for example, genus *Schizosaccharomyces*), Nadsonioideae, Lipomycoideae and Saccharomycoideae (for example, genera *Pichia*, *Kluyveromyces* and *Saccharomyces*). The Basidiosporogenous yeasts include the genera *Leucosporidim*, *Rhodosporidium*, *Sporidiobolus*, *Filobasidium* and *Filobasidiella*. Yeast belonging to the Fungi Imperfecti are divided into two families, Sporobolomycetaceae (for example, genera *Sorobolomyces* and *Bullera*) and Cryptococcaceae (for example, genus *Candida*). Since the classification of yeast may change in the future, for the purposes of this invention, yeast shall be defined as described in Biology and Activities of Yeast (Skinner et al., *Soc. App. Bacteriol. Symposium Series* No. 9, (1980), the entirety of which is herein incorporated by reference). The biology of yeast and manipulation of yeast genetics are well known in the art (see, for example, *Biochemistry and Genetics of Yeast*, Bacil et al. (ed.), 2nd edition, 1987; *The Yeasts*, Rose and Harrison (eds.), 2nd ed., (1987); and *The Molecular Biology of the Yeast Saccharomyces*, Strathern et al. (eds.), (1981), all of which are herein incorporated by reference in their entirety).

"Fungi" as used herein includes the phyla Ascomycota, Basidiomycota, Chytridiomycota and Zygomycota (as defined by Hawksworth et al., In: Ainsworth and Bisby's *Dictionary of The Fungi*, 8th edition, 1995, CAB International, University Press, Cambridge, UK; the entirety of which is herein incorporated by reference) as well as the Oomycota (as cited in Hawksworth et al., In: Ainsworth and Bisby's *Dictionary of The Fungi*, 8th edition, 1995, CAB International, University Press, Cambridge, UK) and all mitosporic fungi (Hawksworth et al., In: Ainsworth and Bisby's *Dictionary of The Fungi*, 8th edition, 1995, CAB International, University Press, Cambridge, UK). Representative groups of Ascomycota include, for example, *Neurospora*, *Eupenicillium* (=*Penicillium*), *Emericella* (=*Aspergillus*), *Eurotiun* (=*Aspergillus*) and the true yeasts listed above. Examples of Basidiomycota include mushrooms, rusts and smuts. Representative groups of Chytridiomycota include, for example, Allomyces, Blastocladiella, Coelomomyces and aquatic fungi. Representative groups of Oomycota include, for example, Saprolegniomycetous aquatic fungi (water molds) such as Achlya. Examples of mitosporic fungi include *Aspergillus*, *Penicilliun*, *Candida* and *Alternaria*. Representative groups of Zygomycota include, for example, *Rhizopus* and *Mucor*.

"Filamentous fungi" include all filamentous forms of the subdivision Eumycota and Oomycota (as defined by Hawksworth et al., In: Ainsworth and Bisby's *Dictionary of The Fungi*, 8th edition, 1995, CAB International, University Press, Cambridge, UK). The filamentous fungi are characterized by a vegetative mycelium composed of chitin, cellulose, glucan, chitosan, mannan and other complex polysaccharides. Vegetative growth is by hyphal elongation and carbon catabolism is obligately aerobic. In contrast, vegetative growth by yeasts such as *Saccharomyces cerevisiae* is by budding of a unicellular thallus and carbon catabolism may be fermentative.

In one embodiment, the fungal host cell is a yeast cell. In a preferred embodiment, the yeast host cell is a cell of the species of *Candida*, *Kluyveromyces*, *Saccharomyces*, *Schizosaccharomyces*, *Pichia* and *Yarrowia*. In a preferred embodiment, the yeast host cell is a *Saccharomyces cerevisiae* cell, a *Saccharomyces carlsbergensis*, *Saccharomyces diastaticus* cell, a *Saccharomyces douglasii* cell, a *Saccharomyces kluyveri* cell, a *Saccharomyces norbensis* cell, or a *Saccharomyces oviformis* cell. In another preferred embodiment, the yeast host cell is a *Kluyveromyces lactis* cell. In another preferred embodiment, the yeast host cell is a *Yarrowia lipolytica* cell.

In another embodiment, the fungal host cell is a filamentous fungal cell. In a preferred embodiment, the filamentous fungal host cell is a cell of the species of, but not limited to, *Acremonium*, *Aspergillus*, *Fusarium*, *Humicola*, *Myceliophthora*, *Mucor*, *Neurospora*, *Penicillium*, *Thielavia*, *Tolypocladium* and *Trichoderma*. In a preferred embodiment, the filamentous fungal host cell is an *Aspergillus* cell. In another preferred embodiment, the filamentous fungal host cell is an *Acremonium* cell. In another preferred embodiment, the filamentous fungal host cell is a *Fusarium* cell. In another preferred embodiment, the filamentous fungal host cell is a *Humicola* cell. In another preferred embodiment, the filamentous fungal host cell is a *Myceliophthora* cell. In another even preferred embodiment, the filamentous fungal host cell is a *Mucor* cell. In another preferred embodiment, the filamentous fungal host cell is a *Neurospora* cell. In another preferred embodiment, the filamentous fungal host cell is a *Penicillium* cell. In another preferred embodiment, the filamentous fungal host cell is a *Thielavia* cell. In another preferred embodiment, the filamentous fungal host cell is a *Tolypocladiun* cell. In another preferred embodiment, the filamentous fungal host cell is a *Trichoderma* cell. In a preferred embodiment, the filamentous fungal host cell is an *Aspergillus oryzae* cell, an *Aspergillus niger* cell, an *Aspergillus foetidus* cell, or an *Aspergillus japonicus* cell. In another preferred embodiment, the filamentous fungal host cell is a *Fusarium oxysporum* cell or a *Fusarium graminearum* cell. In another preferred embodiment, the filamentous fungal host cell is a *Humicola insolens* cell or a *Humicola lanuginosus* cell. In another preferred embodiment, the filamentous fungal host cell is a *Myceliophthora thermophila* cell. In a most preferred embodiment, the filamentous fungal host cell is a *Mucor miehei* cell. In a most preferred embodiment, the filamentous fungal host cell is a *Neurospora crassa* cell. In a most preferred embodiment, the filamentous fungal host cell is a *Penicillium purpurogenum* cell. In another most preferred embodiment, the filamentous fungal host cell is a *Thielavia terrestris* cell. In another most preferred embodiment, the *Trichoderma* cell is a *Trichoderma reesei* cell, a *Trichoderna viride* cell, a *Trichoderma longibrachiatum* cell, a *Trichoderma harzianum* cell, or a *Trichoderma koningii* cell. In a preferred embodiment, the fungal host cell is selected from an *A. nidulans* cell, an *A. niger* cell, an *A. oryzae* cell and an *A. sojae* cell. In a further preferred embodiment, the fungal host cell is an *A. nidulans* cell.

The recombinant fungal host cells of the present invention may further comprise one or more sequences which encode one or more factors that are advantageous in the expression of the protein or fragment thereof, for example, an activator (e.g., a trans-acting factor), a chaperone and a processing protease. The nucleic acids encoding one or more of these factors are preferably not operably linked to the nucleic acid encoding the protein or fragment thereof. An activator is a protein which activates transcription of a nucleic acid sequence encoding a polypeptide (Kudla et al., *EMBO* 9:1355-1364(1990); Jarai and Buxton, *Current Genetics* 26:2238-244(1994); Verdier, *Yeast* 6:271-297(1990), all of which are herein incorporated by reference in their entirety). The nucleic acid sequence encoding an activator may be obtained from the genes encoding *Saccharomyces cerevisiae* heme activator protein 1 (hap1), *Saccharomyces cerevisiae* galactose metabolizing protein 4 (gal4) and *Aspergillus nidulans* ammonia regulation protein (areA). For further examples, see Verdier, *Yeast* 6:271-297 (1990); MacKenzie et al., *Journal of Gen. Microbiol.* 139:2295-2307 (1993), both of which are herein incorporated by reference in their entirety). A chaperone is a protein which assists another protein in folding properly (Hartl et al., *TIBS* 19:20-25 (1994); Bergeron et al., *TIBS* 19:124-128 (1994); Demolder et al., *J. Biotechnology* 32:179-189 (1994); Craig, *Science* 260:1902-1903(1993); Gething and Sambrook, *Nature* 355:33-45 (1992); Puig and Gilbert, *J Biol. Chem.* 269:7764-7771 (1994); Wang and Tsou, *FASEB Journal* 7:1515-11157 (1993); Robinson et al., *Bio/Technology* 1:381-384 (1994), all of which are herein incorporated by reference in their entirety). The nucleic acid sequence encoding a chaperone may be obtained from the genes encoding *Aspergillus oryzae* protein disulphide isomerase, *Saccharomyces cerevisiae* calnexin, *Saccharomyces cerevisiae* BiP/GRP78 and *Saccharomyces cerevisiae* sp70. For further examples, see Gething and Sambrook, *Nature* 355:33-45 (1992); Hartl et al., *TIBS* 19:20-25 (1994). A processing protease is a protease that cleaves a propeptide to generate a mature biochemically active polypeptide (Enderlin and Ogrydziak, *Yeast* 10:67-79 (1994); Fuller et al., *Proc. Natl. Acad. Sci.* (U.S.A.) 86:1434-1438 (1989); Julius et al., *Cell* 37:1075-1089 (1984); Julius et al., *Cell* 32:839-852 (1983), all of which are incorporated by reference in their entirety). The nucleic acid sequence encoding a processing protease may be obtained from the genes encoding *Aspergillus niger* Kex2, *Saccharomyces cerevisiae* dipeptidylaminopeptidase, *Saccharomyces cerevisiae* Kex2 and *Yarrowia lipolytica* dibasic processing endoprotease (xpr6). Any factor that is functional in the fungal host cell of choice may be used in the present invention.

Fungal cells may be transformed by a process involving protoplast formation, transformation of the protoplasts and regeneration of the cell wall in a manner known per se. Suitable procedures for transformation of Aspergillus host cells are described in EP 238 023 and Yelton et al., *Proc. Natl. Acad. Sci.* (U.S.A.) 81:1470-1474 (1984), both of which are herein incorporated by reference in their entirety. A suitable method of transforming *Fusarium* species is described by Malardier et al., *Gene* 78:147-156 (1989), the entirety of which is herein incorporated by reference. Yeast may be transformed using the procedures described by Becker and Guarente, In: Abelson and Simon, (eds.), *Guide to Yeast Genetics and Molecular Biology, Methods Enzymol.* Volume 194, pp 182-187, Academic Press, Inc., New York; Ito et al., *J. Bacteriology* 153:163 (1983); Hinnen et al., *Proc. Natl. Acad. Sci.* (U.S.A.) 75:1920 (1978), all of which are herein incorporated by reference in their entirety.

The present invention also relates to methods of producing the protein or fragment thereof comprising culturing the recombinant fungal host cells under conditions conducive for expression of the protein or fragment thereof. The fungal cells of the present invention are cultivated in a nutrient medium suitable for production of the protein or fragment thereof using methods known in the art. For example, the cell may be cultivated by shake flask cultivation, small-scale or large-scale fermentation (including continuous, batch, fed-batch, or solid state fermentations) in laboratory or industrial fermentors performed in a suitable medium and under conditions allowing the protein or fragment thereof to be expressed and/or isolated. The cultivation takes place in a suitable nutrient medium comprising carbon and nitrogen sources and inorganic salts, using procedures known in the art (see, e.g., Bennett and LaSure (eds.), *More Gene Manipulations in Fungi*, Academic Press, CA, (1991), the entirety of which is herein incorporated by reference). Suitable media are available from commercial suppliers or may be prepared according to published compositions (e.g., in catalogues of the American Type Culture Collection, Manassas, Va.). If the protein or fragment thereof is secreted into the nutrient medium, a protein or fragment thereof can be recovered directly from the medium. If the protein or fragment thereof is not secreted, it is recovered from cell lysates.

The expressed protein or fragment thereof may be detected using methods known in the art that are specific for the particular protein or fragment. These detection methods may include the use of specific antibodies, formation of an enzyme product, or disappearance of an enzyme substrate. For example, if the protein or fragment thereof has enzymatic activity, an enzyme assay may be used. Alternatively, if polyclonal or monoclonal antibodies specific to the protein or fragment thereof are available, immunoassays may be employed using the antibodies to the protein or fragment thereof. The techniques of enzyme assay and immunoassay are well known to those skilled in the art.

The resulting protein or fragment thereof may be recovered by methods known in the arts. For example, the protein or fragment thereof may be recovered from the nutrient medium by conventional procedures including, but not limited to, centrifugation, filtration, extraction, spray-drying, evaporation, or precipitation. The recovered protein or fragment thereof may then be further purified by a variety of chromatographic procedures, e.g., ion exchange chromatography, gel filtration chromatography, affinity chromatography, or the like.

(c) Mammalian Constructs and Transformed Mammalian Cells

The present invention also relates to methods for obtaining a recombinant mammalian host cell, comprising introducing into a mammalian host cell exogenous genetic material. The present invention also relates to a mammalian cell comprising a mammalian recombinant vector. The present invention also relates to methods for obtaining a recombinant mammalian host cell, comprising introducing into a mammalian cell exogenous genetic material. In a preferred embodiment the exogenous genetic material includes a nucleic acid molecule of the present invention having a sequence selected from the group consisting of SEQ ID NO: 1 through SEQ ID NO: 2814 or complements thereof or fragments of either or other nucleic acid molecule of the present invention.

Mammalian cell lines available as hosts for expression are known in the art and include many immortalized cell lines available from the American Type Culture Collection (ATCC, Manassas, Va.), such as HeLa cells, Chinese hamster ovary (CHO) cells, baby hamster kidney (BHK) cells and a number of other cell lines. Suitable promoters for mammalian cells are also known in the art and include viral promoters such as that from Simian Virus 40 (SV40) (Fiers et al., Nature 273: 113 (1978), the entirety of which is herein incorporated by reference), Rous sarcoma virus (RSV), adenovirus (ADV) and bovine papilloma virus (BPV). Mammalian cells may also require terminator sequences and poly-A addition sequences. Enhancer sequences which increase expression may also be included and sequences which promote amplification of the gene may also be desirable (for example methotrexate resistance genes).

Vectors suitable for replication in mammalian cells may include viral replicons, or sequences which insure integration of the appropriate sequences encoding HCV epitopes into the host genome. For example, another vector used to express foreign DNA is vaccinia virus. In this case, for example, a nucleic acid molecule encoding a protein or fragment thereof is inserted into the vaccinia genome. Techniques for the insertion of foreign DNA into the vaccinia virus genome are known in the art and may utilize, for example, homologous recombination. Such heterologous DNA is generally inserted into a gene which is non-essential to the virus, for example, the thymidine kinase gene (tk), which also provides a selectable marker. Plasmid vectors that greatly facilitate the construction of recombinant viruses have been described (see, for example, Mackett et al, *J Virol.* 49:857 (1984); Chakrabarti et al., *Mol. Cell. Biol.* 5:3403 (1985); Moss, In: *Gene Transfer Vectors For Mammalian Cells* (Miller and Calos, eds., Cold Spring Harbor Laboratory, N.Y., p. 10, (1987); all of which are herein incorporated by reference in their entirety). Expression of the HCV polypeptide then occurs in cells or animals which are infected with the live recombinant vaccinia virus.

The sequence to be integrated into the mammalian sequence may be introduced into the primary host by any convenient means, which includes calcium precipitated DNA, spheroplast fusion, transformation, electroporation, biolistics, lipofection, microinjection, or other convenient means. Where an amplifiable gene is being employed, the amplifiable gene may serve as the selection marker for selecting hosts into which the amplifiable gene has been introduced. Alternatively, one may include with the amplifiable gene another marker, such as a drug resistance marker, e.g. neomycin resistance (G418 in mammalian cells), hygromycin in resistance etc., or an auxotrophy marker (HIS3, TRP1, LEU2, URA3, ADE2, LYS2, etc.) for use in yeast cells.

Depending upon the nature of the modification and associated targeting construct, various techniques may be employed for identifying targeted integration. Conveniently, the DNA may be digested with one or more restriction enzymes and the fragments probed with an appropriate DNA fragment which will identify the properly sized restriction fragment associated with integration.

One may use different promoter sequences, enhancer sequences, or other sequence which will allow for enhanced levels of expression in the expression host. Thus, one may combine an enhancer from one source, a promoter region from another source, a 5'-noncoding region upstream from the initiation sucrose from the same or different source as the other sequences and the like. One may provide for an intron in the non-coding region with appropriate splice sites or for an alternative 3'-untranslated sequence or polyadenylation site. Depending upon the particular purpose of the modification, any of these sequences may be introduced, as desired.

Where selection is intended, the sequence to be integrated will have with it a marker gene, which allows for selection. The marker gene may conveniently be downstream from the target gene and may include resistance to a cytotoxic agent, e.g. antibiotics, heavy metals, or the like, resistance or susceptibility to HAT, gancyclovir, etc., complementation to an auxotrophic host, particularly by using an auxotrophic yeast as the host for the subject manipulations, or the like. The marker gene may also be on a separate DNA molecule, particularly with primary mammalian cells. Alternatively, one may screen the various transformants, due to the high efficiency of recombination in yeast, by using hybridization analysis, PCR, sequencing, or the like.

For homologous recombination, constructs can be prepared where the amplifiable gene will be flanked, normally on both sides with DNA homologous with the DNA of the target region. Depending upon the nature of the integrating DNA and the purpose of the integration, the homologous DNA will generally be within 100 kb, usually 50 kb, preferably about 25 kb, of the transcribed region of the target gene, more preferably within 2 kb of the target gene. Where modeling of the gene is intended, homology will usually be present proximal to the site of the mutation. The homologous DNA may include the 5'-upstream region outside of the transcriptional regulatory region or comprising any enhancer sequences, transcriptional initiation sequences, adjacent sequences, or the like. The homologous region may include a portion of the coding region, where the coding region may be comprised only of an open reading frame or combination of exons and introns. The homologous region may comprise all or a portion of an intron, where all or a portion of one or more exons may also be present. Alternatively, the homologous region may comprise the 3'-region, so as to comprise all or a portion of the transcriptional termination region, or the region 3' of this region. The homologous regions may extend over all or a portion of the target gene or be outside the target gene comprising all or a portion of the transcriptional regulatory regions and/or the structural gene.

The integrating constructs may be prepared in accordance with conventional ways, where sequences may be synthesized, isolated from natural sources, manipulated, cloned, ligated, subjected to in vitro mutagenesis, primer repair, or the like. At various stages, the joined sequences may be cloned and analyzed by restriction analysis, sequencing, or the like. Usually during the preparation of a construct where various fragments are joined, the fragments, intermediate constructs and constructs will be carried on a cloning vector comprising a replication system functional in a prokaryotic host, e.g., *E. coli* and a marker for selection, e.g., biocide resistance, complementation to an auxotrophic host, etc. Other functional sequences may also be present, such as polylinkers, for ease of introduction and excision of the construct or portions thereof, or the like. A large number of cloning vectors are available such as pBR322, the pUC series, etc. These constructs may then be used for integration into the primary mammalian host.

In the case of the primary mammalian host, a replicating vector may be used. Usually, such vector will have a viral replication system, such as SV40, bovine papilloma virus, adenovirus, or the like. The linear DNA sequence vector may also have a selectable marker for identifying transfected cells. Selectable markers include the neo gene, allowing for selection with G418, the herpes tk gene for selection with HAT medium, the gpt gene with mycophenolic acid, complementation of an auxotrophic host, etc.

The vector may or may not be capable of stable maintenance in the host. Where the vector is capable of stable maintenance, the cells will be screened for homologous integration of the vector into the genome of the host, where various techniques for curing the cells may be employed. Where the vector is not capable of stable maintenance, for example, where a temperature sensitive replication system is employed, one may change the temperature from the permissive temperature to the non-permissive temperature, so that the cells may be cured of the vector. In this case, only those cells having integration of the construct comprising the amplifiable gene and, when present, the selectable marker, will be able to survive selection.

Where a selectable marker is present, one may select for the presence of the targeting construct by means of the selectable marker. Where the selectable marker is not present, one may select for the presence of the construct by the amplifiable gene. For the neo gene or the herpes tk gene, one could employ a medium for growth of the transformants of about 0.1-1 mg/ml of G418 or may use HAT medium, respectively. Where DHFR is the amplifiable gene, the selective medium may include from about 0.01-0.5 M of methotrexate or be deficient in glycine-hypoxanthine-thymidine and have dialysed serum (GHT media).

The DNA can be introduced into the expression host by a variety of techniques that include calcium phosphate/DNA co-precipitates, microinjection of DNA into the nucleus, electroporation, yeast protoplast fusion with intact cells, transfection, polycations, e.g., polybrene, polyornithine, etc., or the like. The DNA may be single or double stranded DNA, linear or circular. The various techniques for transforming mammalian cells are well known (see Keown et al., *Methods Enzymol.* (1989); Keown et al., *Methods Enzymol.* 185:527-537 (1990); Mansour et al., *Nature* 336:348-352, (1988); all of which are herein incorporated by reference in their entirety).

(d) Insect Constructs and Transformed Insect Cells

The present invention also relates to an insect recombinant vectors comprising exogenous genetic material. The present invention also relates to an insect cell comprising an insect recombinant vector. The present invention also relates to methods for obtaining a recombinant insect host cell, comprising introducing into an insect cell exogenous genetic material. In a preferred embodiment the exogenous genetic material includes a nucleic acid molecule of the present invention having a sequence selected from the group consisting of SEQ ID NO: 1 through SEQ ID NO: 2814 or complements thereof or fragments of either or other nucleic acid molecule of the present invention.

The insect recombinant vector may be any vector which can be conveniently subjected to recombinant DNA procedures and can bring about the expression of the nucleic acid sequence. The choice of a vector will typically depend on the compatibility of the vector with the insect host cell into which the vector is to be introduced. The vector may be a linear or a closed circular plasmid. The vector system may be a single vector or plasmid or two or more vectors or plasmids which together contain the total DNA to be introduced into the genome of the insect host. In addition, the insect vector may be an expression vector. Nucleic acid molecules can be suitably inserted into a replication vector for expression in the insect cell under a suitable promoter for insect cells. Many vectors are available for this purpose and selection of the appropriate vector will depend mainly on the size of the nucleic acid molecule to be inserted into the vector and the particular host cell to be transformed with the vector. Each vector contains various components depending on its function (amplification of DNA or expression of DNA) and the particular host cell with which it is compatible. The vector components for insect cell transformation generally include, but are not limited to, one or more of the following: a signal sequence, origin of replication, one or more marker genes and an inducible promoter.

The insect vector may be an autonomously replicating vector, i.e., a vector which exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the insect cell, is integrated into the genome and replicated together with the chromosome(s) into which it has been integrated. For integration, the vector may rely on the nucleic acid sequence of the vector for stable integration of the vector into the genome by homologous or nonhomologous recombination. Alternatively, the vector may contain additional nucleic acid sequences for directing integration by homologous recombination into the genome of the insect host. The additional nucleic acid sequences enable the vector to be integrated into the host cell genome at a precise location(s) in the chromosome(s). To increase the likelihood of integration at a precise location, there should be preferably two nucleic acid sequences which individually contain a sufficient number of nucleic acids, preferably 400 bp to 1500 bp, more preferably 800 bp to 1000 bp, which are highly homologous with the corresponding target sequence to enhance the probability of homologous recombination. These nucleic acid sequences may be any sequence that is homologous with a target sequence in the genome of the insect host cell and, furthermore, may be non-encoding or encoding sequences.

Baculovirus expression vectors (BEVs) have become important tools for the expression of foreign genes, both for basic research and for the production of proteins with direct clinical applications in human and veterinary medicine (Doerfler, *Curr. Top. Microbiol. Immunol.* 131:51-68 (1968); Luckow and Summers, *Bio/Technology* 6:47-55 (1988a); Miller, *Annual Review of Microbiol.* 42:177-199 (1988); Summers, *Curr. Comm. Molecular Biology*, Cold Spring Harbor Press, Cold Spring Harbor, N.Y. (1988); all of which are herein incorporated by reference in their entirety). BEVs are recombinant insect viruses in which the coding sequence for a chosen foreign gene has been inserted behind a baculovirus promoter in place of the viral gene, e.g., polyhedrin (Smith and Summers, U.S. Pat. No. 4,745,051, the entirety of which is incorporated herein by reference).

The use of baculovirus vectors relies upon the host cells being derived from Lepidopteran insects such as *Spodoptera frugiperda* or *Trichoplusia ni*. The preferred *Spodoptera frugiperda* cell line is the cell line Sf9. The *Spodoptera frugiperda* Sf9 cell line was obtained from American Type Culture Collection (Manassas, Va.) and is assigned accession number ATCC CRL 1711 (Summers and Smith, *A Manual of Methods for Baculovirus Vectors and Insect Cell Culture Procedures*, Texas Ag. Exper. Station Bulletin No. 1555 (1988), the entirety of which is herein incorporated by reference). Other insect cell systems, such as the silkworm *B. mori* may also be used.

The proteins expressed by the BEVs are, therefore, synthesized, modified and transported in host cells derived from Lepidopteran insects. Most of the genes that have been inserted and produced in the baculovirus expression vector system have been derived from vertebrate species. Other baculovirus genes in addition to the polyhedrin promoter may be employed to advantage in a baculovirus expression system. These include immediate-early (alpha), delayed-early ( ), late ( ), or very late (delta), according to the phase of the viral infection during which they are expressed. The expression of these genes occurs sequentially, probably as the result of a "cascade" mechanism of transcriptional regulation. (Guarino and Summers, *J. Virol.* 57:563-571 (1986); Guarino and Summers, *J. Virol.* 61:2091-2099 (1987); Guarino and Summers, *Virol.* 162:444-451 (1988); all of which are herein incorporated by reference in their entirety).

Insect recombinant vectors are useful as intermediates for the infection or transformation of insect cell systems. For example, an insect recombinant vector containing a nucleic acid molecule encoding a baculovirus transcriptional promoter followed downstream by an insect signal DNA sequence is capable of directing the secretion of the desired biologically active protein from the insect cell. The vector may utilize a baculovirus transcriptional promoter region derived from any of the over 500 baculoviruses generally infecting insects, such as for example the Orders Lepidoptera, Diptera, Orthoptera, Coleoptera and Hymenoptera, including for example but not limited to the viral DNAs of *Autographa californica* MNPV, *Bombyx mori* NPV, *Trichoplusia ni* MNPV, *Rachiplusia ou* MNPV or *Galleria mellonella* MNPV, wherein said baculovirus transcriptional promoter is a baculovirus immediate-early gene IE1 or IEN promoter; an immediate-early gene in combination with a baculovirus delayed-early gene promoter region selected from the group consisting of 39K and a HindIII-k fragment delayed-early gene; or a baculovirus late gene promoter. The immediate-early or delayed-early promoters can be enhanced with transcriptional enhancer elements. The insect signal DNA sequence may code for a signal peptide of a Lepidopteran adipokinetic hormone precursor or a signal peptide of the *Manduca sexta* adipokinetic hormone precursor (Summers, U.S. Pat. No. 5,155,037; the entirety of which is herein incorporated by reference). Other insect signal DNA sequences include a signal peptide of the *Orthoptera Schistocerca gregaria* locust adipokinetic hormone precurser and the *Drosophila melanogaster* cuticle genes CP1, CP2, CP3 or CP4 or for an insect signal peptide having substantially a similar chemical composition and function (Summers, U.S. Pat. No. 5,155,037).

Insect cells are distinctly different from animal cells. Insects have a unique life cycle and have distinct cellular properties such as the lack of intracellular plasminogen activators in which are present in vertebrate cells. Another difference is the high expression levels of protein products ranging from 1 to greater than 500 mg/liter and the ease at which cDNA can be cloned into cells (Frasier, *In Vitro Cell. Dev. Biol.* 25:225 (1989); Summers and Smith, In: *A Manual of Methods for Baculovirus Vectors and Insect Cell Culture Procedures*, Texas Ag. Exper. Station Bulletin No. 1555 (1988), both of which are incorporated by reference in their entirety).

Recombinant protein expression in insect cells is achieved by viral infection or stable transformation. For viral infection, the desired gene is cloned into baculovirus at the site of the wild-type polyhedron gene (Webb and Summers, *Technique* 2:173 (1990); Bishop and Posse, *Adv. Gene Technol.* 1:55 (1990); both of which are incorporated by reference in their entirety). The polyhedron gene is a component of a protein coat in occlusions which encapsulate virus particles. Deletion or insertion in the polyhedron gene results the failure to form occlusion bodies. Occlusion negative viruses are morphologically different from occlusion positive viruses and enable one skilled in the art to identify and purify recombinant viruses.

The vectors of present invention preferably contain one or more selectable markers which permit easy selection of transformed cells. A selectable marker is a gene the product of which provides, for example biocide or viral resistance, resistance to heavy metals, prototrophy to auxotrophs and the like. Selection may be accomplished by co-transformation, e.g., as described in WO 91/17243, a nucleic acid sequence of the present invention may be operably linked to a suitable promoter sequence. The promoter sequence is a nucleic acid sequence which is recognized by the insect host cell for expression of the nucleic acid sequence. The promoter sequence contains transcription and translation control sequences which mediate the expression of the protein or fragment thereof. The promoter may be any nucleic acid sequence which shows transcriptional activity in the insect host cell of choice and may be obtained from genes encoding polypeptides either homologous or heterologous to the host cell.

For example, a nucleic acid molecule encoding a protein or fragment thereof may also be operably linked to a suitable leader sequence. A leader sequence is a nontranslated region of a mRNA which is important for translation by the fungal host. The leader sequence is operably linked to the 5' terminus of the nucleic acid sequence encoding the protein or fragment thereof. The leader sequence may be native to the nucleic acid sequence encoding the protein or fragment thereof or may be obtained from foreign sources. Any leader sequence which is functional in the insect host cell of choice may be used in the present invention.

A polyadenylation sequence may also be operably linked to the 3' terminus of the nucleic acid sequence of the present invention. The polyadenylation sequence is a sequence which when transcribed is recognized by the insect host to add polyadenosine residues to transcribed mRNA. The polyadenylation sequence may be native to the nucleic acid sequence encoding the protein or fragment thereof or may be obtained from foreign sources. Any polyadenylation sequence which is functional in the fungal host of choice may be used in the present invention.

To avoid the necessity of disrupting the cell to obtain the protein or fragment thereof and to minimize the amount of possible degradation of the expressed polypeptide within the cell, it is preferred that expression of the polypeptide gene gives rise to a product secreted outside the cell. To this end, the protein or fragment thereof of the present invention may be linked to a signal peptide linked to the amino terminus of the protein or fragment thereof. A signal peptide is an amino acid sequence which permits the secretion of the protein or fragment thereof from the insect host into the culture medium. The signal peptide may be native to the protein or fragment thereof of the invention or may be obtained from foreign sources. The 5' end of the coding sequence of the nucleic acid sequence of the present invention may inherently contain a signal peptide coding region naturally linked in translation reading frame with the segment of the coding region which encodes the secreted protein or fragment thereof.

At present, a mode of achieving secretion of a foreign gene product in insect cells is by way of the foreign gene's native signal peptide. Because the foreign genes are usually from non-insect organisms, their signal sequences may be poorly recognized by insect cells and hence, levels of expression may be suboptimal. However, the efficiency of expression of foreign gene products seems to depend primarily on the characteristics of the foreign protein. On average, nuclear localized or non-structural proteins are most highly expressed, secreted proteins are intermediate and integral membrane proteins are the least expressed. One factor generally affecting the efficiency of the production of foreign gene products in a heterologous host system is the presence of native signal sequences (also termed presequences, targeting signals, or leader sequences) associated with the foreign gene. The signal sequence is generally coded by a DNA sequence immediately following (5' to 3') the translation start site of the desired foreign gene.

The expression dependence on the type of signal sequence associated with a gene product can be represented by the following example: If a foreign gene is inserted at a site downstream from the translational start site of the baculovirus polyhedrin gene so as to produce a fusion protein (containing the N-terminus of the polyhedrin structural gene), the fused gene is highly expressed. But less expression is achieved when a foreign gene is inserted in a baculovirus expression vector immediately following the transcriptional start site and totally replacing the polyhedrin structural gene.

Insertions into the region −50 to −1 significantly alter (reduce) steady state transcription which, in turn, reduces translation of the foreign gene product. Use of the pVL941 vector optimizes transcription of foreign genes to the level of the polyhedrin gene transcription. Even though the transcription of a foreign gene may be optimal, optimal translation may vary because of several factors involving processing: signal peptide recognition, mRNA and ribosome binding, glycosylation, disulfide bond formation, sugar processing, oligomerization, for example.

The properties of the insect signal peptide are expected to be more optimal for the efficiency of the translation process in insect cells than those from vertebrate proteins. This phenomenon can generally be explained by the fact that proteins secreted from cells are synthesized as precursor molecules containing hydrophobic N-terminal signal peptides. The signal peptides direct transport of the select protein to its target membrane and are then cleaved by a peptidase on the membrane, such as the endoplasmic reticulum, when the protein passes through it.

Another exemplary insect signal sequence is the sequence encoding for *Drosophila* cuticle proteins such as CP1, CP2, CP3 or CP4 (Summers, U.S. Pat. No. 5,278,050; the entirety of which is herein incorporated by reference). Most of a 9 kb region of the *Drosophila* genome containing genes for the cuticle proteins has been sequenced. Four of the five cuticle genes contains a signal peptide coding sequence interrupted by a short intervening sequence (about 60 base pairs) at a conserved site. Conserved sequences occur in the 5' mRNA untranslated region, in the adjacent 35 base pairs of upstream flanking sequence and at −200 base pairs from the mRNA start position in each of the cuticle genes.

Standard methods of insect cell culture, cotransfection and preparation of plasmids are set forth in Summers and Smith (Summers and Smith, *A Manual of Methods for Baculovirus Vectors and Insect Cell Culture Procedures*, Texas Agricultural Experiment Station Bulletin No. 1555, Texas A&M University (1987)). Procedures for the cultivation of viruses and cells are described in Volkman and Summers, *J. Virol* 19:820-832 (1975) and Volkman et al., *J. Virol* 19:820-832 (1976); both of which are herein incorporated by reference in their entirety.

(e) Bacterial Constructs and Transformed Bacterial Cells

The present invention also relates to a bacterial recombinant vector comprising exogenous genetic material. The present invention also relates to a bacteria cell comprising a bacterial recombinant vector. The present invention also relates to methods for obtaining a recombinant bacteria host cell, comprising introducing into a bacterial host cell exogenous genetic material. In a preferred embodiment the exogenous genetic material includes a nucleic acid molecule of the present invention having a sequence selected from the group consisting of SEQ ID NO: 1 through SEQ ID NO: 2814 or complements thereof or fragments of either or other nucleic acid molecule of the present invention.

The bacterial recombinant vector may be any vector which can be conveniently subjected to recombinant DNA procedures. The choice of a vector will typically depend on the compatibility of the vector with the bacterial host cell into which the vector is to be introduced. The vector may be a linear or a closed circular plasmid. The vector system may be a single vector or plasmid or two or more vectors or plasmids which together contain the total DNA to be introduced into the genome of the bacterial host. In addition, the bacterial vector may be an expression vector. Nucleic acid molecules encoding protein homologues or fragments thereof can, for example, be suitably inserted into a replicable vector for expression in the bacterium under the control of a suitable promoter for bacteria. Many vectors are available for this purpose and selection of the appropriate vector will depend mainly on the size of the nucleic acid to be inserted into the vector and the particular host cell to be transformed with the vector. Each vector contains various components depending on its function (amplification of DNA or expression of DNA) and the particular host cell with which it is compatible. The vector components for bacterial transformation generally include, but are not limited to, one or more of the following: a signal sequence, an origin of replication, one or more marker genes and an inducible promoter.

In general, plasmid vectors containing replicon and control sequences that are derived from species compatible with the host cell are used in connection with bacterial hosts. The vector ordinarily carries a replication site, as well as marking sequences that are capable of providing phenotypic selection in transformed cells. For example, *E. coli* is typically transformed using pBR322, a plasmid derived from an *E. coli* species (see, e.g., Bolivar et al., *Gene* 2:95 (1977); the entirety of which is herein incorporated by reference). pBR322 contains genes for ampicillin and tetracycline resistance and thus provides easy means for identifying transformed cells. The pBR322 plasmid, or other microbial plasmid or phage, also generally contains, or is modified to contain, promoters that can be used by the microbial organism for expression of the selectable marker genes.

Nucleic acid molecules encoding protein or fragments thereof may be expressed not only directly, but also as a fusion with another polypeptide, preferably a signal sequence or other polypeptide having a specific cleavage site at the N-terminus of the mature polypeptide. In general, the signal sequence may be a component of the vector, or it may be a part of the polypeptide DNA that is inserted into the vector. The heterologous signal sequence selected should be one that is recognized and processed (i.e., cleaved by a signal peptidase) by the host cell. For bacterial host cells that do not recognize and process the native polypeptide signal sequence, the signal sequence is substituted by a bacterial signal sequence selected, for example, from the group consisting of the alkaline phosphatase, penicillinase, lpp, or heat-stable enterotoxin II leaders.

Both expression and cloning vectors contain a nucleic acid sequence that enables the vector to replicate in one or more selected host cells. Generally, in cloning vectors this sequence is one that enables the vector to replicate independently of the host chromosomal DNA and, includes origins of replication or autonomously replicating sequences. Such sequences are well known for a variety of bacteria. The origin of replication from the plasmid pBR322 is suitable for most Gram-negative bacteria.

Expression and cloning vectors also generally contain a selection gene, also termed a selectable marker. This gene encodes a protein necessary for the survival or growth of transformed host cells grown in a selective culture medium. Host cells not transformed with the vector containing the selection gene will not survive in the culture medium. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for *Bacilli*. One example of a selection scheme utilizes a drug to arrest growth of a host cell. Those cells that are successfully transformed with a heterologous protein homologue or fragment thereof produce a protein conferring drug resistance and thus survive the selection regimen.

The expression vector for producing a protein or fragment thereof can also contains an inducible promoter that is recognized by the host bacterial organism and is operably linked to the nucleic acid encoding, for example, the nucleic acid molecule encoding the protein homologue or fragment thereof of interest. Inducible promoters suitable for use with bacterial hosts include the -lactamase and lactose promoter systems (Chang et al., *Nature* 275:615 (1978); Goeddel et al., *Nature* 281:544 (1979); both of which are herein incorporated by reference in their entirety), the arabinose promoter system (Guzman et al., *J. Bacteriol.* 174:7716-7728 (1992); the entirety of which is herein incorporated by reference), alkaline phosphatase, a tryptophan (trp) promoter system (Goeddel, *Nucleic Acids Res.* 8:4057 (1980); EP 36,776; both of which are herein incorporated by reference in their entirety) and hybrid promoters such as the tac promoter (deBoer et al., *Proc. Natl. Acad. Sci. (USA)* 80:21-25 (1983); the entirety of which is herein incorporated by reference). However, other known bacterial inducible promoters are suitable (Siebenlist et al., *Cell* 20:269 (1980); the entirety of which is herein incorporated by reference).

Promoters for use in bacterial systems also generally contain a Shine-Dalgarno (S.D.) sequence operably linked to the DNA encoding the polypeptide of interest. The promoter can be removed from the bacterial source DNA by restriction enzyme digestion and inserted into the vector containing the desired DNA.

Construction of suitable vectors containing one or more of the above-listed components employs standard ligation techniques. Isolated plasmids or DNA fragments are cleaved, tailored and re-ligated in the form desired to generate the plasmids required. Examples of available bacterial expression vectors include, but are not limited to, the multifunctional *E. coli* cloning and expression vectors such as Bluescript™ (Stratagene, La Jolla, Calif.), in which, for example, encoding an *A. nidulans* protein homologue or fragment thereof homologue, may be ligated into the vector in frame with sequences for the amino-terminal Met and the subsequent 7 residues of -galactosidase so that a hybrid protein is produced; pIN vectors (Van Heeke and Schuster, *J. Biol. Chem.* 264:5503-5509 (1989), the entirety of which is herein incorporated by reference); and the like. pGEX vectors (Promega, Madison, Wis. U.S.A.) may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems are designed to include heparin, thrombin or factor XA protease cleavage sites so that the cloned polypeptide of interest can be released from the GST moiety at will.

Suitable host bacteria for a bacterial vector include archaebacteria and eubacteria, especially eubacteria and most preferably Enterobacteriaceae. Examples of useful bacteria include *Escherichia, Enterobacter, Azotobacter, Erwinia, Bacillus, Pseudomonas, Klebsiella, Proteus, Salmonella, Serratia, Shigella, Rhizobia, Vitreoscilla* and *Paracoccus*. Suitable *E. coli* hosts include *E. coli* W3110 (American Type Culture Collection (ATCC) 27,325, Manassas, Va. U.S.A.), *E. coli* 294 (ATCC 31,446), *E. coli* B and *E. coli* X1776 (ATCC 31,537). These examples are illustrative rather than limiting. Mutant cells of any of the above-mentioned bacteria may also be employed. It is, of course, necessary to select the appropriate bacteria taking into consideration replicability of the replicon in the cells of a bacterium. For example, *E. coli, Serratia*, or *Salmonella* species can be suitably used as the host when well known plasmids such as pBR322, pBR325, pACYC177, or pKN410 are used to supply the replicon. *E. coli* strain W3110 is a preferred host or parent host because it is a common host strain for recombinant DNA product fermentations. Preferably, the host cell should secrete minimal amounts of proteolytic enzymes.

Host cells are transfected and preferably transformed with the above-described vectors and cultured in conventional nutrient media modified as appropriate for inducing promoters, selecting transformants, or amplifying the genes encoding the desired sequences.

Numerous methods of transfection are known to the ordinarily skilled artisan, for example, calcium phosphate and electroporation. Depending on the host cell used, transformation is done using standard techniques appropriate to such cells. The calcium treatment employing calcium chloride, as described in section 1.82 of Sambrook et al., *Molecular Cloning: A Laboratory Manual*, New York: Cold Spring Harbor Laboratory Press, (1989), is generally used for bacterial cells that contain substantial cell-wall barriers. Another method for transformation employs polyethylene glycol/DMSO, as described in Chung and Miller (Chung and Miller, *Nucleic Acids Res.* 16:3580 (1988); the entirety of which is herein incorporated by reference). Yet another method is the use of the technique termed electroporation.

Bacterial cells used to produce the polypeptide of interest for purposes of this invention are cultured in suitable media in which the promoters for the nucleic acid encoding the heterologous polypeptide can be artificially induced as described generally, e.g., in Sambrook et al., *Molecular Cloning: A Laboratory Manual*, New York: Cold Spring Harbor Laboratory Press, (1989). Examples of suitable media are given in U.S. Pat. Nos. 5,304,472 and 5,342,763; both of which are incorporated by reference in their entirety.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones, (see for example, Sambrook et al., *Molecular Cloning: A Laboratory Manual*, Cold Spring Harbor Press (1989); Mailga et al., *Methods in Plant Molecular Biology*, Cold Spring Harbor Press (1995), the entirety of which is herein incorporated by reference; Birren et al., *Genome Analysis: Analyzing DNA*, 1, Cold Spring Harbor, N.Y., the entirety of which is herein incorporated by reference).

(f) Computer Readable Media

The nucleotide sequence provided in SEQ ID NO: 1 through SEQ ID NO: 2814 or fragment thereof, or complement thereof, or a nucleotide sequence at least 90% identical, preferably 95%, identical even more preferably 99% or 100% identical to the sequence provided in SEQ ID NO: 1 through SEQ ID NO: 2814 or fragment thereof, or complement thereof, can be "provided" in a variety of mediums to facilitate use. Such a medium can also provide a subset thereof in a form that allows a skilled artisan to examine the sequences.

A preferred subset of nucleotide sequences are those nucleic acid sequences that encodes a maize or a soybean triose phosphate isomerase enzyme or complement thereof or fragment of either, a nucleic acid molecule that encodes a maize or a soybean fructose 1,6-bisphosphate aldolase enzyme or complement thereof or fragment of either, a nucleic acid molecule that encodes a maize or a soybean fructose 1,6-bisphosphate enzyme or complement thereof or fragment of either, a nucleic acid molecule that encodes a maize or a soybean fructose 6-phosphate 2-kinase enzyme or complement thereof or fragment of either, a nucleic acid molecule that encodes a maize or a soybean phosphoglucoisomerase enzyme or complement thereof or fragmnt of either, a nucleic acid molecule that encodes a maize or a soybean vacuolar H$^+$ translocating-pyrophosphatase enzyme or complement thereof or fragment of either, a nucleic acid molecule that encodes a maize or a soybean pyrophosphate-dependent fructose-6-phosphate phosphotransferase enzyme or complement thereof or fragment of either, a nucleic acid molecule that encodes a maize or a soybean invertase enzyme or complement thereof or fragment of either, a nucleic acid molecule that encodes a maize or a soybean sucrose synthase enzyme or complement thereof or fragment of either, a nucleic acid molecule that encodes a maize or a soybean hexokinase enzyme or complement thereof or fragment of either, a nucleic acid molecule that encodes a maize or a soybean fructokinase enzyme or complement thereof or fragment of either f, a nucleic acid molecule that encodes a maize or a soybean NDP-kinase enzyme or complement thereof or fragment of either, a nucleic acid molecule that encodes a maize or a soybean glucose-6-phosphate 1-dehydrogenase enzyme or complement thereof or fragment of either, a nucleic acid molecule that encodes a maize or a soybean phosphoglucomutase enzyme or complement thereof or fragment of either and a nucleic acid molecule that encodes a maize or a soybean UDP-glucose pyrophophorylase enzyme or complement thereof or fragment of either.

A further preferred subset of nucleic acid sequences is where the subset of sequences is two proteins or fragments thereof, more preferably three proteins or fragments thereof and even more preferable four proteins or fragments thereof, these nucleic acid sequences are selected from the group that comprises a maize or a soybean triose phosphate isomerase enzyme or complement thereof or fragment of either, a nucleic acid molecule that encodes a maize or a soybean fructose 1,6-bisphosphate aldolase enzyme or complement thereof or fragment of either, a nucleic acid molecule that encodes a maize or a soybean fructose 1,6-bisphosphate enzyme or complement thereof or fragment of either, a nucleic acid molecule that encodes a maize or a soybean fructose 6-phosphate 2-kinase enzyme or complement thereof or fragment of either, a nucleic acid molecule that encodes a maize or a soybean phosphoglucoisomerase enzyme or complement thereof or fragment of either, a nucleic acid molecule that encodes a maize or a soybean vacuolar H$^+$ translocating-pyrophosphatase enzyme or complement thereof or fragment of either, a nucleic acid molecule that encodes a maize or a soybean pyrophosphate-dependent fructose-6-phosphate phosphotransferase enzyme or complement thereof or fragment of either, a nucleic acid molecule that encodes a maize or a soybean invertase enzyme or complement thereof or fragment of either, a nucleic acid molecule that encodes a maize or a soybean sucrose synthase enzyme or complement thereof or fragment of either, a nucleic acid molecule that encodes a maize or a soybean hexokinase enzyme or complement thereof or fragment of either, a nucleic acid molecule that encodes a maize or a soybean fructokinase enzyme or complement thereof or fragment of either f, a nucleic acid molecule that encodes a maize or a soybean NDP-kinase enzyme or complement thereof or fragment of either, a nucleic acid molecule that encodes a maize or a soybean glucose-6-phosphate 1-dehydrogenase enzyme or complement thereof or fragment of either, a nucleic acid molecule that encodes a maize or a soybean phosphoglucomutase enzyme or complement thereof or fragment of either and a nucleic acid molecule that encodes a maize or a soybean UDP-glucose pyrophophorylase enzyme or complement thereof or fragment of either.

In one application of this embodiment, a nucleotide sequence of the present invention can be recorded on computer readable media. As used herein, "computer readable media" refers to any medium that can be read and accessed directly by a computer. Such media include, but are not limited to: magnetic storage media, such as floppy discs, hard disc, storage medium and magnetic tape: optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data processor structuring formats (e.g. text file or database) in order to obtain computer readable medium having recorded thereon the nucleotide sequence information of the present invention.

By providing one or more of nucleotide sequences of the present invention, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., *J. Mol. Biol.* 215:403-410 (1990), the entirety of which is herein incorporated by reference) and BLAZE (Brutlag et al., *Comp. Chem.* 17:203-207 (1993), the entirety of which is herein incorporated by reference) search algorithms on a Sybase system can be used to identify open reading frames (ORFs) within the genome that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification and DNA replication, restriction, modification, recombination and repair.

The present invention further provides systems, particularly computer-based systems, which contain the sequence information described herein. Such systems are designed to identify commercially important fragments of the nucleic acid molecule of the present invention. As used herein, "a computer-based system" refers to the hardware means, software means and data storage means used to analyze the nucleotide sequence information of the present invention. The minimum hardware means of the computer-based systems of the present invention comprises a central processing unit (CPU), input means, output means and data storage means. A skilled artisan can readily appreciate that any one of the currently available computer-based system are suitable for use in the present invention.

As indicated above, the computer-based systems of the present invention comprise a data storage means having stored therein a nucleotide sequence of the present invention and the necessary hardware means and software means for supporting and implementing a search means. As used herein, "data storage means" refers to memory that can store nucleotide sequence information of the present invention, or a memory access means which can access manufactures having recorded thereon the nucleotide sequence information of the present invention. As used herein, "search means" refers to one or more programs which are implemented on the computer-based system to compare a target sequence or target structural motif with the sequence information stored within the data storage means. Search means are used to identify fragments or regions of the sequence of the present invention that match a particular target sequence or target motif. A variety of known algorithms are disclosed publicly and a variety of commercially available software for conducting search means are available can be used in the computer-based systems of the present invention. Examples of such software include, but are not limited to, MacPattern (EMBL), BLASTIN and BLASTIX (NCBIA). One of the available algorithms or implementing software packages for conducting homology searches can be adapted for use in the present computer-based systems.

The most preferred sequence length of a target sequence is from about 10 to 100 amino acids or from about 30 to 300 nucleotide residues. However, it is well recognized that during searches for commercially important fragments of the nucleic acid molecules of the present invention, such as sequence fragments involved in gene expression and protein processing, may be of shorter length.

As used herein, "a target structural motif," or "target motif," refers to any rationally selected sequence or combination of sequences in which the sequences the sequence(s) are chosen based on a three-dimensional configuration which is formed upon the folding of the target motif. There are a variety of target motifs known in the art. Protein target motifs include, but are not limited to, enzymatic active sites and signal sequences. Nucleic acid target motifs include, but are not limited to, promoter sequences, cis elements, hairpin structures and inducible expression elements (protein binding sequences).

Thus, the present invention further provides an input means for receiving a target sequence, a data storage means for storing the target sequences of the present invention sequence identified using a search means as described above and an output means for outputting the identified homologous sequences. A variety of structural formats for the input and output means can be used to input and output information in the computer-based systems of the present invention. A preferred format for an output means ranks fragments of the sequence of the present invention by varying degrees of homology to the target sequence or target motif. Such presentation provides a skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments sequence of the present invention. For example, implementing software which implement the BLAST and BLAZE algorithms (Altschul et al., *J. Mol. Biol.* 215:403-410 (1990)) can be used to identify open frames within the nucleic acid molecules of the present invention. A skilled artisan can readily recognize that any one of the publicly available homology search programs can be used as the search means for the computer-based systems of the present invention.

Having now generally described the invention, the same will be more readily understood through reference to the following examples which are provided by way of illustration and are not intended to be limiting of the present invention, unless specified.

EXAMPLE 1

The MONN01 cDNA library is a normalized library generated from maize (DK604, Dekalb Genetics, Dekalb, Ill. U.S.A.) total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The older, more juvenile leaves, which are in a basal position, as well as the younger, more adult leaves, which are more apical are cut at the base of the leaves. The leaves are then pooled and immediately transferred to liquid nitrogen containers in which the pooled leaves are crushed. The harvested tissue is then stored at −80° C. until RNA preparation.

The SATMON001 cDNA library is generated from maize (B73, Illinois Foundation Seeds, Champaign, Ill. U.S.A.) immature tassels at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue from the maize plant is collected at the V6 stage. At that stage the tassel is an immature tassel of about 2-3 cm in length. The tassels are removed and frozen in liquid nitrogen. The harvested tissue is then stored at −80° C. until RNA preparation.

The SATMON003 library is generated from maize (B73× Mo17, Illinois Foundation Seeds, Champaign, Ill. U.S.A.) roots at the V6 developmental stage. Seeds are planted at a depth of approximately 3 cm in coil into 2-3 inch peat pots containing Metro 200 growing medium. After 2-3 weeks growth, the seedlings are transplanted into 10 inch pots containing the Metro 200 growing medium. Plants are watered daily before transplantation and approximately 3 times a week after transplantation. Peters 15-16-17 fertilizer is applied approximately three times per week after transplanting at a concentration of 150 ppm N. Two to three times during the life time of the plant from transplanting to flowering a total of approximately 900 mg Fe is added to each pot. Maize plants are grown in the green house in approximately 15 hr day/9 hr night cycles. The daytime temperature is approximately 80° F and the nighttime temperature is approximately 70° F. Supplemental lighting is provided by 1000 W sodium vapor lamps. Tissue is collected when the maize plant is at the 6 leaf development stage. The root system is cut from maize plant and washed with water to free it from the soil. The tissue is then immediately frozen in liquid nitrogen. The harvested tissue is then stored at −80° C. until RNA preparation.

The SATMON004 cDNA library is generated from maize (B73×Mo17, Illinois Foundation Seeds, Champaign, Ill. U.S.A.) total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The older, more juvenile leaves, which are in a basal position, as well as the younger, more adult leaves, which are more apical are cut at the base of the leaves. The leaves are then pooled and immediately transferred to liquid nitrogen containers in which the pooled leaves are crushed. The harvested tissue is then stored at −80° C. until RNA preparation.

The SATMON005 cDNA library is generated from maize (B73×Mo17, Illinois Foundation Seeds, Champaign, Ill., U.S.A.) root tissue at the V6 development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The root system is cut from the mature maize plant and washed with water to free it from the soil. The tissue is immediately frozen in liquid nitrogen and the harvested tissue is then stored at −80° C. until RNA preparation.

The SATMON006 cDNA library is generated from maize (B73×Mo17, Illinois Foundation Seeds, Champaign, Ill., U.S.A.) total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The older more juvenile leaves, which are in a basal position, as well as the younger more adult leaves, which are more apical are cut at the base of the leaves. The leaves are then pooled and immediately transferred to liquid nitrogen containers in which the pooled leaves are crushed. The harvested tissue is then stored at −80° C. until RNA preparation.

The SATMON007 cDNA library is generated from the primary root tissue of 5 day old maize (DK604, Dekalb Genetics, Dekalb, Ill. U.S.A.) seedlings. Seeds are planted on a moist filter paper on a covered tray that is kept in the dark until germination (one day). After germination, the trays, along with the moist paper, are moved to a greenhouse where the maize plants are grown in the greenhouse in 15 hr day/9 hr night cycles for approximately 5 days. The daytime temperature is approximately 80° F. and the nighttime temperature is approximately 70° F. Supplemental lighting is provided by 1000 W sodium vapor lamps. The primary root tissue is collected when the seedlings are 5 days old. At this stage, the primary root (radicle) is pushed through the coleorhiza which itself is pushed through the seed coat. The primary root, which is about 2-3 cm long, is cut and immediately frozen in liquid nitrogen and then stored at −80° C. until RNA preparation.

The SATMON008 cDNA library is generated from the primary shoot (coleoptile 2-3 cm) of maize (DK604, Dekalb Genetics, Dekalb, Ill. U.S.A.) seedlings which are approximately 5 days old. Seeds are planted on a moist filter paper on a covered tray that is kept in the dark until germination (one day). Then the trays containing the seeds are moved to a greenhouse at 15hr daytime/9 hr nighttime cycles and grown until they are 5 days post germination. The daytime temperature is approximately 80° F. and the nighttime temperature is approximately 70° F. Tissue is collected when the seedlings are 5 days old. At this stage, the primary shoot (coleoptile) is pushed through the seed coat and is about 2-3 cm long. The coleoptile is dissected away from the rest of the seedling, immediately frozen in liquid nitrogen and then stored at −80° C. until RNA preparation.

The SATMON009 cDNA library is generated from maize (DK604, Dekalb Genetics, Dekalb, Ill. U.S.A.) leaves at the 8 leaf stage (V8 plant development stage). Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is 80OF and the nighttime temperature is 70° F. Supplemental lighting is provided by 1000 W sodium vapor lamps. Tissue is collected when the maize plant is at the 8-leaf development stage. The older more juvenile leaves, which are in a basal position, as well as the younger more adult leaves, which are more apical, are cut at the base of the leaves. The leaves are then pooled and then immediately transferred to liquid nitrogen containers in which the pooled leaves are crushed. The harvested tissue is then stored at −80° C. until RNA preparation.

The SATMON010 cDNA library is generated from maize (DK604, Dekalb Genetics, Dekalb, Ill. U.S.A.) root tissue at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is 80° F. and the nighttime temperature is 70° F. Supplemental lighting is provided by 1000 W sodium vapor lamps. Tissue is collected when the maize plant is at the V8 development stage. The root system is cut from this mature maize plant and washed with water to free it from the soil. The tissue is immediately frozen in liquid nitrogen. The harvested tissue is then stored at −80° C. until RNA preparation.

The SATMON011 cDNA library is generated from undeveloped maize (DK604, Dekalb Genetics, Dekalb, Ill. U.S.A.) leaf at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The second youngest leaf which is at the base of the apical leaf of V6 stage maize plant is cut at the base and immediately transferred to liquid nitrogen containers in which the leaf is crushed. The harvested tissue is then stored at −80° C. until RNA preparation.

The SATMON012 cDNA library is generated from 2 day post germination maize (DK604, Dekalb Genetics, Dekalb, Ill. U.S.A.) seedlings. Seeds are planted on a moist filter paper on a covered tray that is kept in the dark until germination (one day). Then the trays containing the seeds are moved to the greenhouse and grown at 15hr daytime/9 hr nighttime cycles until 2 days post germination. The daytime temperature is approximately 80° F. and the nighttime temperature is approximately 70° F. Tissue is collected when the seedlings are 2 days old. At the two day stage, the coleorhiza is pushed through the seed coat and the primary root (the radicle) is pierced the coleorhiza but is barely visible. Also, at this two day stage, the coleoptile is just emerging from the seed coat. The 2 days post germination seedlings are then immersed in liquid nitrogen and crushed. The harvested tissue is stored at −80° C. until preparation of total RNA.

The SATMON013 cDNA library is generated from apical maize (DK604, Dekalb Genetics, Dekalb, Ill. U.S.A.) meristem founder at the V4 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Prior to tissue collection, the plant is at the 4 leaf stage. The lead at the apex of the V4 stage maize plant is referred to as the meristem founder. This apical meristem founder is cut, immediately frozen in liquid nitrogen and crushed. The harvested tissue is then stored at −80° C. until RNA preparation.

The SATMON014 cDNA library is generated from maize (DK604, Dekalb Genetics, Dekalb, Ill. U.S.A.) endosperm fourteen days after pollination. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. After the V10 stage, the maize plant ear shoots are ready for fertilization. At this stage, the ear shoots are enclosed in a paper bag before silk emergence to withhold the pollen. The ear shoots are pollinated and 14 days after pollination, the ears are pulled out and then the kernels are plucked out of the ears. Each kernel is then dissected into the embryo and the endosperm and the aleurone layer is removed. After dissection, the endosperms are immediately frozen in liquid nitrogen and then stored at −80° C. until RNA preparation.

The SATMON016 library is a maize (DK604, Dekalb Genetics, Dekalb, Illinois U.S.A.) sheath library collected at the V8 developmental stage. Seeds are planted in a depth of approximately 3 cm in solid into 2-3 inch pots containing Metro growing medium. After 2-3 weeks growth, they are transplanted into 10" pots containing the same. Plants are watered daily before transplantation and approximately the times a week after transplantation. Peters 15-16-17 fertilizer is applied approximately three times per week after transplanting, at a strength of 150 ppm N. Two to three times during the life time of the plant from transplanting to flowering, a total of approximately 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. When the maize plants are at the V8 stage the $5^{th}$ and $6^{th}$ leaves from the bottom exhibit fully developed leaf blades. At the base of these leaves, the ligule is differentiated and the leaf blade is joined to the sheath. The sheath is dissected away from the base of the leaf then the sheath is frozen in liquid nitrogen and crushed. The tissue is then stored at −80° C. until RNA preparation.

The SATMON017 cDNA library is generated from maize (DK604, Dekalb Genetics, Dekalb, Ill. U.S.A.) embryo seventeen days after pollination. Seeds are planted at a depth of approximately 3 cm into 2-3 inch peat pots containing Metro 200 growing medium. After 2-3 weeks growth the seeds are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. After the V10 stage, the ear shoots of maize plant, which are ready for fertilization, are enclosed in a paper bag before silk emergence to withhold the pollen. The ear shoots are fertilized and 21 days after pollination, the ears are pulled out and the kernels are plucked out of the ears. Each kernel is then dissected into the embryo and the endosperm and the aleurone layer is removed. After dissection, the embryos are immediately frozen in liquid nitrogen and then stored at −80° C. until RNA preparation.

The SATMON019 (Lib3054) cDNA library is generated from maize (DK604, Dekalb Genetics, Dekalb, Ill. U.S.A.) culm (stem) at the V8 developmental stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. When the maize plant is at the V8 stage, the 5th and 6th leaves from the bottom have fully developed leaf blades. The region between the nodes of the 5th and the sixth leaves from the bottom is the region of the stem that is collected. The leaves are pulled out and the sheath is also torn away from the stem. This stem tissue is completely free of any leaf and sheath tissue. The stem tissue is then frozen in liquid nitrogen and stored at −80° C. until RNA preparation.

The SATMON020 cDNA library is from a maize (DK604, Dekalb Genetics, Dekalb, Ill. U.S.A.) Hill Type II-Initiated Callus. Petri plates containing approximately 25 ml of Type II initiation media are prepared. This medium contains N6 salts and vitamins, 3% sucrose, 2.3 g/liter proline 0.1 g/liter enzymatic casein hydrolysate, 2mg/liter 2,4-dichloro phenoxy-acetic acid (2,4, D), 15.3 mg/liter $AgNO_3$ and 0.8% bacto agar and is adjusted to pH 6.0 before autoclaving. At 9-11 days after pollination, an ear with immature embryos measuring approximately 1-2 mm in length is chosen. The husks and silks are removed and then the ear is broken into halves and placed in an autoclaved solution of Clorox/TWEEN 20 sterilizing solution. Then the ear is rinsed with deionized water. Then each embryo is extracted from the kernel. Intact embryos are placed in contact with the medium, scutellar side up). Multiple embryos are plated on each plate and the plates are incubated in the dark at 25° C. Type II calluses are friable, can be subcultured with a spatula, frequently regenerate via somatic embryogenesis and are relatively undifferentiated. As seen in the microscope, the Tape II calluses show color ranging from translucent to light yellow and heterogeneity on with respect to embryoid structure as well as stage of embryoid development. Once Type II callus are formed, the calluses is transferred to type II callus maintenance medium without $AgNO_3$. Every 7-10 days, the callus is subcultured. About 4 weeks after embryo isolation the callus is removed from the plates and then frozen in liquid nitrogen. The harvested tissue is stored at −80° C. until RNA preparation.

The SATMON021 cDNA library is generated from the immature maize (DK604, Dekalb Genetics, Dekalb, Ill. U.S.A.) tassel at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. As the maize plant enters the V8 stage, tassels which are 15-20 cm in length are collected and frozen in liquid nitrogen. The harvested tissue is stored at −80° C. until RNA preparation.

The SATMON022 cDNA library is generated from maize (DK604, Dekalb Genetics, Dekalb, Ill. U.S.A.) ear (growing silks) at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. *Zea mays* plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the plant is in the V8 stage. At this stage, some immature ear shoots are visible. The immature ear shoots (approximately 1 cm in length) are pulled out, frozen in liquid nitrogen and then stored at −80° C. until RNA preparation.

The SATMON23 cDNA library is generated from maize (DK604, Dekalb Genetics, Dekalb, Ill. U.S.A.) ear (growing silk) at the V8 development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. When the tissue is harvested at the V8 stage, the length of the ear that is harvested is about 10-15 cm and the silks are just exposed (approximately 1 inch). The ear along with the silks is frozen in liquid nitrogen and then the tissue is stored at −80° C. until RNA preparation.

The SATMON024 cDNA library is generated from the immature maize (DK604, Dekalb Genetics, Dekalb, Ill. U.S.A.) tassel at the V9 development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. As a maize plant enters the V9 stage, the tassel is rapidly developing and a 37 cm tassel along with the glume, anthers and pollen is collected and frozen in liquid nitrogen. The harvested tissue is stored at −80° C. until RNA preparation.

The SATMON025 cDNA library is from maize (DK604, Dekalb Genetics, Dekalb, Ill. U.S.A.) Hill Type II-Regenerated Callus. Type II callus is grown in initiation media as described for SATMON020 and then the embryoids on the surface of the Type II callus are allowed to mature and germinate. The 1-2 gm fresh weight of the soft friable type callus containing numerous embryoids are transferred to 100×15 mm petri plates containing 25 ml of regeneration media. Regeneration media consists of Murashige and Skoog (MS) basal salts, modified White's vitamins (0.2 g/liter glycine and 0.5 g/liter myo-inositol and 0.8% bacto agar (6SMS0D)). The plates are then placed in the dark after covering with parafilm. After 1 week, the plates are moved to a lighted growth chamber with 16 hr light and 8 hr dark photoperiod. Three weeks after plating the Type II callus to 6SMS0D, the callus exhibit shoot formation. The callus and the shoots are transferred to fresh 6SMS0D plates for another 2 weeks. The callus and the shoots are then transferred to petri plates with reduced sucrose (3SMS0D). Upon distinct formation of a root and shoot, the newly developed green plants are then removed out with a spatula and frozen in liquid nitrogen containers. The harvested tissue is then stored at −80° C. until RNA preparation.

The SATMON026 cDNA library is generated from maize (DK604, Dekalb Genetics, Dekalb, Ill. U.S.A.) juvenile/adult shift leaves at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plants are at the 8-leaf development stage. Leaves are founded sequentially around the meristem over weeks of time and the older, more juvenile leaves arise earlier and in a more basal position than the younger, more adult leaves, which are in a more apical position. In a V8 plant, some leaves which are in the middle portion of the plant exhibit characteristics of both juvenile as well as adult leaves. They exhibit a yellowing color but also exhibit, in part, a green color. These leaves are termed juvenile/adult shift leaves. The juvenile/adult shift leaves (the 4th, 5th leaves from the bottom) are cut at the base, pooled and transferred to liquid nitrogen in which they are then crushed. The harvested tissue is then stored at −80° C. until RNA preparation.

The SATMON027 cDNA library is generated from 6 day maize (DK604, Dekalb Genetics, Dekalb, Ill. U.S.A.) leaves. Seeds are planted at a depth of approximately 3 cm into 2-3 inch peat pots containing Metro 200 growing medium. After 2-3 weeks growth they are transplanted into 10 inch pots containing the Metro 200 growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. *Zea mays* plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Prior to tissue collection, when the plant is at the 8-leaf stage, water is held back for six days. The older, more juvenile leaves, which are in a basal position, as well as the younger, more adult leaves, which are more apical, are all cut at the base of the leaves. All the leaves exhibit significant wilting. The leaves are then pooled and immediately transferred to liquid nitrogen containers in which the pooled leaves are then crushed. The harvested tissue is then stored at −80° C. until RNA preparation.

The SATMON028 cDNA library is generated from maize (DK604, Dekalb Genetics, Dekalb, Ill. U.S.A.) roots at the V8 developmental stage that are subject to six days water stress. Seeds are planted at a depth of approximately 3 cm into 2-3 inch peat pots containing Metro 200 growing medium. After 2-3 weeks growth they are transplanted into 10 inch pots containing the Metro 200 growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Prior to tissue collection, when the plant is at the 8-leaf stage, water is held back for six days. The root system is cut, shaken and washed to remove soil. Root tissue is then pooled and immediately transferred to liquid nitrogen containers in which the pooled leaves are then crushed. The harvested tissue is then stored at −80° C. until RNA preparation.

The SATMON029 cDNA library is generated from maize (DK604, Dekalb Genetics, Dekalb, Ill. U.S.A.) seedlings at the etiolated stage. Seeds are planted on a moist filter paper on a covered tray that is kept in the dark for 4 days at approximately 70° F. Tissue is collected when the seedlings are 4 days old. By 4 days, the primary root has penetrated the coleorhiza and is about 4-5 cm and the secondary lateral roots have also made their appearance. The coleoptile has also pushed through the seed coat and is about 4-5 cm long. The seedlings are frozen in liquid nitrogen and crushed. The harvested tissue is then stored at −80° C. until RNA preparation.

The SATMON030 cDNA library is generated from maize (DK604, Dekalb Genetics, Dekalb, Ill. U.S.A.) root tissue at the V4 plant development stage. Seeds are planted at a depth of approximately 3 cm into 2-3 inch peat pots containing Metro 200 growing medium. After 2-3 weeks growth, they are transplanted into 10 inch pots containing the same. Plants are watered daily before transplantation and approximately 3 times a week after transplantation. Peters 15-16-17 fertilizer is applied approximately three times per week after transplanting, at a strength of 150 ppm N. Two to three times during the life time of the plant, from transplanting to flowering, a total of approximately 900 mg Fe is added to each pot. Maize plants are grown in the green house in 1 5hr day/9hr night cycles. The daytime temperature is approximately 80° F. and the nighttime temperature is approximately 70° F. Supplemental lighting is provided by 1000 sodium vapor lamps. Tissue is collected when the maize plant is at the 4 leaf development stage. The root system is cut from the mature maize plant and washed with water to free it from the soil. The tissue is then immediately frozen in liquid nitrogen. The harvested tissue is then stored at −80° C. until RNA preparation.

The SATMON031 cDNA library is generated from the maize (DK604, Dekalb Genetics, Dekalb, Ill. U.S.A.) leaf tissue at the V4 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is 80° F. and the nighttime temperature is 70° F. Supplemental lighting is provided by 1000 W sodium vapor lamps. Tissue is collected when the maize plant is at the 4-leaf development stage. The third leaf from the bottom is cut at the base and immediately frozen in liquid nitrogen and crushed. The tissue is immediately frozen in liquid nitrogen. The harvested tissue is then stored at −80° C. until RNA preparation.

The SATMON033 cDNA library is generated from maize (DK604, Dekalb Genetics, Dekalb, Ill. U.S.A.) embryo tissue 13 days after pollination. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. After the V10 stage, the ear shoots of the maize plant, which are ready for fertilization, are enclosed in a paper bag before silk emergent to withhold the pollen. The ear shoots are pollinated and 13 days after pollination, the ears are pulled out and then the kernels are plucked cut of the ears. Each kernel is then dissected into the embryo and the endosperm and the aleurone layer is removed. After dissection, the embryos are immediately frozen in liquid nitrogen and then stored at −80° C. until RNA preparation.

The SATMON034 cDNA library is generated from cold stressed maize (DK604, Dekalb Genetics, Dekalb, Ill. U.S.A.) seedlings. Seeds are planted on a moist filter paper on a covered tray that is kept on at 10° C. for 7 days. After 7 days, the temperature is shifted to 15° C. for one day until germination of the seed. Tissue is collected once the seedlings are 1 day old. At this point, the coleorhiza has just pushed out of the seed coat and the primary root is just making its appearance. The coleoptile has not yet pushed completely through the seed coat and is also just making its appearance. These 1 day old cold stressed seedlings are frozen in liquid nitrogen and crushed. The harvested tissue is then stored at −80° C. until RNA preparation.

The SATMON~001 (Lib36, Lib83, Lib84) cDNA library is generated from maize leaves at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue from the maize plant is collected at the V8 stage. The older more juvenile leaves in a basal position was well as the younger more adult leaves which are more apical are all cut at the base, pooled and frozen in liquid nitrogen. The harvested tissue is then stored at −80° C. until RNA preparation.

The SATMONN01 cDNA library is generated from maize (B73, Illinois Foundation Seeds, Champaign, Ill. U.S.A.) normalized immature tassels at the V6 plant development stage normalized tissue. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue from the maize plant is collected at the V6 stage. At that stage the tassel is an immature tassel of about 2-3 cm in length. The tassels are removed and frozen in liquid nitrogen. The harvested tissue is then stored at −80° C. until RNA preparation. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are converted to double stranded form and represent the primary normalized library.

The SATMONN04 cDNA library is generated from maize (B73×Mo17, Illinois Foundation Seeds, Champaign, Ill. U.S.A.) normalized total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The older, more juvenile leaves, which are in a basal position, as well as the younger, more adult leaves, which are more apical are cut at the base of the leaves. The leaves are then pooled and immediately transferred to liquid nitrogen containers in which the pooled leaves are crushed. The harvested tissue is then stored at −80° C. until RNA preparation. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are converted to double stranded form and represent the primary normalized library.

The SATMONN05 cDNA library is generated from maize (B73×Mo17, Illinois Foundation Seeds, Champaign, Ill., U.S.A.) normalized root tissue at the V6 development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The root system is cut from the mature maize plant and washed with water to free it from the soil. The tissue is immediately frozen in liquid nitrogen and the harvested tissue is then stored at −80° C. until RNA preparation. The single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are converted to double stranded form and represent the primary normalized library.

The SATMONN06 cDNA library is generated from maize (B73×Mo17, Illinois Foundation Seeds, Champaign, Ill., U.S.A.) normalized total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The older more juvenile leaves, which are in a basal position, as well as the younger more adult leaves, which are more apical are cut at the base of the leaves. The leaves are then pooled and immediately transferred to liquid nitrogen containers in which the pooled leaves are crushed. The harvested tissue is then stored at −80° C. until RNA preparation. Single stranded and double stranded DNA representing approximately $1 \times 10^6$ colony forming units are isolated using standard protocols. RNA, complementary to the single stranded DNA, is synthesized using the double stranded DNA as a template. Biotinylated DATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are converted to double stranded form and represent the primary normalized library.

The CMZ029 (SATMON036) cDNA library is generated from maize (DK604, Dekalb Genetics, Dekalb, Ill. U.S.A.) endosperm 22 days after pollination. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. After the V10 stage, the ear shoots of the maize plant, which are ready for fertilization, are enclosed in a paper bag before silk emergent to withhold the pollen. The ear shoots are pollinated and 22 days after pollination, the ears are pulled out and then the kernels are plucked out of the ears. Each kernel is then dissected into the embryo and the endosperm and the alurone layer is removed. After dissection, the endosperms are immediately frozen in liquid nitrogen and then stored at −80° C. until RNA preparation.

The CMz030 (Lib143) cDNA library is generated from maize seedling tissue two days post germination. Seeds are planted on a moist filter paper on a covered try that is keep in the dark until germination. The trays are then moved to the bench top at 15 hr daytime/9 hr nighttime cycles for 2 days post-germination. The day time temperature is 80° F. and the nighttime temperature is 70° F. Tissue is collected when the seedlings are 2 days old. At this stage, the colehrhiza has pushed through the seed coat and the primary root (the radicle) is just piercing the colehrhiza and is barely visible. The seedlings are placed at 42° C. for 1 hour. Following the heat shock treatment, the seedlings are immersed in liquid nitrogen and crushed. The harvested tissue is stored at −80° until RNA preparation.

The CMz031 (Lib148) cDNA library is generated from maize pollen tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants. The ear shoots, which are ready for fertilization, are enclosed in a paper bag to withhold pollen. Twenty-one days after pollination, prior to removing the ears, the paper bag is shaken to collect the mature pollen. The mature pollen is immediately frozen in liquid nitrogen containers and the pollen is crushed. The harvested tissue is then stored at −80° C. until RNA preparation.

The CMz033 (Lib189) cDNA library is generated from maize pooled leaf tissue. Samples are harvested from open pollinated plants. Tissue is collected from maize leaves at the anthesis stage. The leaves are collect from 10-12 plants and frozen in liquid nitrogen. The harvested tissue is then stored at −80° C. until RNA preparation.

The CMz034 (Lib3060) cDNA library is generated from maize mature tissue at 40 days post pollination plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from leaves located two leaves below the ear leaf. This sample represents those genes expressed during onset and early stages of leaf senescence. The leaves are pooled and immediately transferred to liquid nitrogen. The harvested tissue is then stored at −80° C. until RNA preparation.

The CMz035 (Lib3061) cDNA library is generated from maize endosperm tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80 F and the nighttime temperature is approximately 70 F. Supplemental lighting is provided by 1000 W sodium vapor lamps. Tissue is collected from V10+ stage plants. The ear shoots, which are ready for fertilization, are enclosed in a paper bag prior to silk emergence to withhold pollen. Thirty-two days after pollination, the ears are pulled out and the kernels are removed from the cob. Each kernel is dissected into the embryo and the endosperm and the aleurone layer is removed. After dissection, the endosperms are immediately transferred to liquid nitrogen. The harvested tissue is then stored at −80 C until RNA preparation.

The CMz036 (Lib3062) cDNA library is generated from maize husk tissue at the 8 week old plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from 8 week old plants. The husk is separated from the ear and immediately transferred to liquid nitrogen containers. The harvested tissue is then stored at −80° C. until RNA preparation.

The CMz037 (Lib3059) cDNA library is generated from maize pooled kernal at 12-15 days after pollienation plant development stage. Sample were collected from field grown material. Whole kernals from hand pollinated (control pollination) are harvested as whole ears and immediately frozen on dry ice. Kernels from 10-12 ears were pooled and ground together in liquid nitrogen. The harvested tissue is then stored at −80° C. until RNA preparation.

The CMz039 (Lib3066) cDNA library is generated from maize immature anther tissue at the 7 week old immature tassel stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 7 week old immature tassel stage. At this stage, prior to anthesis, the immature anthers are green and enclosed in the staminate spikelet. The developing anthers are dissected away from the 7 week old immature tassel and immediately frozen in liquid nitrogen. The harvested tissue is then stored at −80° C. until RNA preparation.

The CMz040 (Lib3067) cDNA library is generated from maize kernel tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants. The ear shoots, which are ready for fertilization, are enclosed in a paper bag before silk emergence to withhold pollen. Five to eight days after controlled pollination. The ears are pulled and the kernels removed. The kernels are immediately frozen in liquid nitrogen. The harvested kernels tissue is then stored at −80° C. until RNA preparation. This sample represents gene expressed in early kernel development, during periods of cell division, amyloplast biogenesis and early carbon flow across the material to filial tissue.

The CMz041 (Lib3068) cDNA library is generated from maize pollen germinating silk tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants when the ear shoots are ready for fertilization at the silk emergence stage. The emerging silks are pollinated with an excess of pollen under controlled pollination conditions in the green house. Eighteen hours after pollination the silks are removed from the ears and immediately frozen in liquid nitrogen containers. This sample represents genes expressed in both pollen and silk tissue early in pollination. The harvested tissue is then stored at −80° C. until RNA preparation.

The CMz042 (Lib3069) cDNA library is generated from maize ear tissue excessively pollinated at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants and the ear shoots which are ready for fertilization are at the silk emergence stage. The immature ears are pollinated with an excess of pollen under controlled pollination conditions. Eighteen hours post-pollination, the ears are removed and immediately transferred to liquid nitrogen containers. The harvested tissue is then stored at −80° C. until RNA preparation.

The CMz044 (Lib3075) cDNA library is generated from maize microspore tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from immature anthers from 7 week old tassels. The immature anthers are first dissected from the 7 week old tassel with a scalpel on a glass slide covered with water. The microspores (immature pollen) are released into the water and are recovered by centrifugation. The microspore suspension is immediately frozen in liquid nitrogen. The harvested tissue is then stored at −80° C. until RNA preparation.

The CMz045 (Lib3076) cDNA library is generated from maize immature ear megaspore tissue. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from immature ear (megaspore) obtained from 7 week old plants. The immature ears are harvested from the 7 week old plants and are approximately 2.5 to 3 cm in length. The kernels are removed from the cob immediately frozen in liquid nitrogen. The harvested tissue is then stored at −80° C. until RNA preparation.

The CMz047 (Lib3078) cDNA library is generated from maize $CO_2$ treated high-exposure shoot tissue at the V10+ plant development stage. RX601 maize seeds are sterilized for i minute with a 10% clorox solution. The seeds are rolled in germination paper, and germinated in 0.5 mM calcium sulfate solution for two days ate 30° C. The seedlings are planted at a depth of approximately 3 cm into 2-3 inch peat pots containing Metro 200 growing medium at a rate of 2-3 seedlings per pot. Twenty pots are placed into a high $CO_2$ environment (approximately 1000 ppm $CO_2$). Twenty plants were grown under ambient greenhouse $CO_2$ (approximately 450 ppm $CO_2$). Plants are watered daily before transplantation and three times a week after transplantation. Peters 20-20-20 fertilizer is also lightly applied. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. At ten days post planting, the shoots from both atmosphere are frozen in liquid nitrogen and lightly ground. The roots are washed in deionized water to remove the support media and the tissue is immediately transferred to liquid nitrogen containers. The harvested tissue is then stored at −80° C. until RNA preparation.

The CMz048 (Lib3079) cDNA library is generated from maize basal endosperm transfer layer tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ maize plants. The ear shoots, which are ready for fertilization, are enclosed in a paper bag prior to silk emergence, to withhold the pollen. Kernels are harvested at 12 days post-pollination and placed on wet ice for dissection. The kernels are cross sectioned laterally, dissecting just above the pedicel region, including 1-2 mm of the lower endosperm and the basal endosperm transfer region. The pedicel and lower endosperm region containing the basal endosperm transfer layer is pooled and immediately frozen in liquid nitrogen. The harvested tissue is then stored at −80° C. until RNA preparation.

The CMz049(Lib3088) cDNA library is generated from maize immature anther tissue at the 7 week old immature tassel stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 7 week old immature tassel stage. At this stage, prior to anthesis, the immature anthers are green and enclosed in the staminate spikelet. The developing anthers are dissected away from the 7 week old immature tassel and immediately transferred to liquid nitrogen container. The harvested tissue is then stored at −80° C. until RNA preparation.

The CMz050 (Lib3114) cDNA library is generated from maize silk tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is beyond the 10-leaf development stage and the ear shoots are approximately 15-20 cm in length. The ears are pulled and silks are separated from the ears and immediately transferred to liquid nitrogen containers. The harvested tissue is then stored at −80° C. until RNA preparation.

The SOYMON001 cDNA library is generated from soybean cultivar Asgrow 3244 (Asgrow Seed Company, Des Moines, Iowa U.S.A.) total leaf tissue at the V4 plant development stage. Leaf tissue from 38, field grown V4 stage plants is harvested from the $4^{th}$ node. Leaf tissue is removed from the plants and immediately frozen in dry-ice. The harvested tissue is then stored at −80° C. until RNA preparation.

The SOYMON002 cDNA library is generated from soybean cultivar Asgrow 3244 (Asgrow Seed Company, Des Moines, Iowa U.S.A.) root tissue at the V4 plant development stage. Root tissue from 76, field grown V4 stage plants is harvested. The root systems is cut from the soybean plant and washed with water to free it from the soil and immediately frozen in dry-ice. The harvested tissue is then stored at −80° C. until RNA preparation.

The SOYMON003 cDNA library is generated from soybean cultivar Asgrow 3244 (Asgrow Seed Company, Des Moines, Iowa U.S.A.) seedling hypocotyl axis tissue harvested 2 day post-imbibition. Seeds are planted at a depth of approximately 2 cm into 2-3 inch peat pots containing Metromix 350 medium. Trays are placed in an environmental chamber and grown at 12 hr daytime/12 hr nighttime cycles. The daytime temperature is approximately 29° C. and the nighttime temperature approximately 24° C. Soil is checked and watered daily to maintain even moisture conditions. Tissue is collected 2 days after the start of imbibition. The 2 days after imbibition samples are separated into 3 collections after removal of any adhering seed coat. At the 2 day stage, the hypocotyl axis is emerging from the soil. A few seedlings have cracked the soil surface and exhibited slight greening of the exposed cotyledons. The seedlings are washed in water to remove soil, hypocotyl axis harvested and immediately frozen in liquid nitrogen. The harvested tissue is then stored at −80° C. until RNA preparation.

The SOYMON004 cDNA library is generated from soybean cultivar Asgrow 3244 (Asgrow Seed Company, Des Moines, Iowa U.S.A.) seedling cotyledon tissue harvested 2 day post-imbibition. Seeds are planted at a depth of approximately 2 cm into 2-3 inch peat pots containing Metromix 350 medium. Trays are placed in an environmental chamber and grown at 12 hr daytime/12 hr nighttime cycles. The daytime temperature is approximately 29° C. and the nighttime temperature approximately 24° C. Soil is checked and watered daily to maintain even moisture conditions. Tissue is collected 2 days after the start of imbibition. The 2 days after imbibition samples are separated into 3 collections after removal of any adhering seed coat. At the 2 day stage, the hypocotyl axis is emerging from the soil. A few seedlings have cracked the soil surface and exhibited slight greening of the exposed cotyledons. The seedlings are washed in water to remove soil, hypocotyl axis harvested and immediately frozen in liquid nitrogen. The harvested tissue is then stored at −80° C. until RNA preparation.

The SOYMON005 cDNA library is generated from soybean cultivar Asgrow 3244 (Asgrow Seed Company, Des Moines, Iowa U.S.A.) seedling hypocotyl axis tissue harvested 6 hour post-imbibition. Seeds are planted at a depth of approximately 2 cm into 2-3 inch peat pots containing Metromix 350 medium. Trays are placed in an environmental chamber and grown at 12 hr daytime/12 hr nighttime cycles. The daytime temperature is approximately 29° C. and the nighttime temperature approximately 24° C. Soil is checked and watered daily to maintain even moisture conditions. Tissue is collected 6 hours after the start of imbibition. The 6 hours after imbibition samples are separated into 3 collections after removal of any adhering seed coat. The 6 hours after imbibition sample is collected over the course of approximately 2 hours starting at 6 hours post imbibition. At the 6 hours after imbibition stage, not all cotyledons have become fully hydrated and germination, or radicle protrusion, has not occurred. The seedlings are washed in water to remove soil, hypocotyl axis harvested and immediately frozen in liquid nitrogen. The harvested tissue is then stored at −80° C. until RNA preparation.

The SOYMON006 cDNA library is generated from soybean cultivar Asgrow 3244 (Asgrow Seed Company, Des Moines, Iowa U.S.A.) seedling cotyledons tissue harvest 6 hour post-imbibition. Seeds are planted at a depth of approximately 2 cm into 2-3 inch peat pots containing Metromix 350 medium. Trays are placed in an environmental chamber and grown at 12 hr daytime/12 hr nightime cycles. The daytime temperature is approximately 29° C. and the nighttime temperature approximately 24° C. Soil is checked and watered daily to maintain even moisture conditions. Tissue is collected 6 hours after imbibition. The 6 hours after imbibition samples are separated into 3 collections after removal of any adhering seed coat. The 6 hours after imbibition sample is collected over the course of approximately 2 hours starting at 6 hours post-imbibition. At the 6 hours after imbibition, not all cotyledons have become fully hydrated and germination or radicle protrusion, have not occurred. The seedlings are washed in water to remove soil, cotyledon harvested and immediately frozen in liquid nitrogen. The harvested tissue is then stored at −80° C. until RNA preparation.

The SOYMON007 cDNA library is generated from soybean cultivar Asgrow 3244 (Asgrow Seed Company, Des Moines, Iowa U.S.A.) seed tissue harvested 25 and 35 days post-flowering. Seed pods from field grown plants are harvested 25 and 35 days after flowering and the seeds extracted from the pods. Approximately 4.4 g and 19.3 g of seeds are harvested from the respective seed pods and immediately frozen in dry ice. The harvested tissue is then stored at −80° C. until RNA preparation.

The SOYMON008 cDNA library is generated from soybean cultivar Asgrow 3244 (Asgrow Seed Company, Des Moines, Iowa U.S.A.) leaf tissue harvested from 25 and 35 days post-flowering plants. Total leaf tissue is harvested from field grown plants. Approximately 19 g and 29 g of leaves are harvested from the fourth node of the plant 25 and 35 days post-flowering and immediately frozen in dry ice. The harvested tissue is then stored at −80° C. until RNA preparation.

The SOYMON009 cDNA library is generated from soybean cultivar C1944 (USDA Soybean Germplasm Collection, Urbana, Ill. U.S.A.) pod and seed tissue harvested 15 days post-flowering. Pods from field grown plants are harvested 15 days post-flowering. Approximately 3 g of pod tissue is harvested and immediately frozen in dry-ice. The harvested tissue is then stored at −80° C. until RNA preparation.

The SOYMON010 cDNA library is generated from soybean cultivar C1944 (USDA Soybean Germplasm Collection, Urbana, Ill. U.S.A.) seed tissue harvested 40 days post-flowering. Pods from field grown plants are harvested 40 days post-flowering. Pods and seeds are separated, approximately 19 g of seed tissue is harvested and immediately frozen in dry-ice. The harvested tissue is then stored at −80° C. until RNA preparation.

The SOYMON011 cDNA library is generated from soybean cultivars Cristalina (USDA Soybean Germplasm Collection, Urbana, Ill. U.S.A.) and FT108 (Monsoy, Brazil) (tropical germ plasma) leaf tissue. Leaves are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 30 g of leaves are harvested from the $4^{th}$ node of each of the Cristalina and FT108 cultivars and immediately frozen in dry ice. The harvested tissue is then stored at −80° C. until RNA preparation.

The SOYMON012 cDNA library is generated from soybean cultivar Asgrow 3244 (Asgrow Seed Company, Des Moines, Iowa U.S.A.) leaf tissue. Leaves from field grown plants are harvested from the fourth node 15 days post-flowering. Approximately 12 g of leaves are harvested and immediately frozen in dry ice. The harvested tissue is then stored at −80° C. until RNA preparation.

The SOYMON013 cDNA library is generated from soybean cultivar Asgrow 3244 (Asgrow Seed Company, Des Moines, Iowa U.S.A.) root and nodule tissue. Approximately, 28 g of root tissue from field grown plants is harvested 15 days post-flowering. The root system is cut from the soybean plant, washed with water to free it from the soil and immediately frozen in dry-ice. The harvested tissue is then stored at −80° C. until RNA preparation.

The SOYMON014 cDNA library is generated from soybean cultivar Asgrow 3244 (Asgrow Seed Company, Des Moines, Iowa U.S.A.) seed tissue harvested 25 and 35 days after flowering. Seed pods from field grown plants are harvested 15 days after flowering and the seeds extracted from the pods. Approximately 5 g of seeds are harvested from the respective seed pods and immediately frozen in dry ice. The harvested tissue is then stored at −80° C. until RNA preparation.

The SOYMON015 cDNA is generated from soybean cultivar Asgrow 3244 (Asgrow Seed Company, Des Moines, Iowa U.S.A.) seed tissue harvested 45 and 55 days post-flowering. Seed pods from field grown plants are harvested 45 and 55 days after flowering and the seeds extracted from the pods. Approximately 19 g and 31 g of seeds are harvested from the respective seed pods and immediately frozen in dry ice. The harvested tissue is then stored at −80° C. until RNA preparation.

The SOYMON016 cDNA library is generated from soybean cultivar Asgrow 3244 (Asgrow Seed Company, Des Moines, Iowa U.S.A.) root tissue. Approximately, 61 g and 38 g of root tissue from field grown plants is harvested 25 and 35 days post-flowering is harvested. The root system is cut from the soybean plant and washed with water to free it from the soil. The tissue is placed in 14ml polystyrene tubes and immediately frozen in dry-ice. The harvested tissue is then stored at −80° C. until RNA preparation.

The SOYMON017 cDNA library is generated from soybean cultivar Asgrow 3244 (Asgrow Seed Company, Des Moines, Iowa U.S.A.) root tissue. Approximately 28 g of root tissue from field grown plants is harvested 45 and 55 days post-flowering. The root system is cut from the soybean plant, washed with water to free it from the soil and immediately frozen in dry-ice. The harvested tissue is then stored at −80° C. until RNA preparation.

The SOYMON018 cDNA is generated from soybean cultivar Asgrow 3244 (Asgrow Seed Company, Des Moines, Iowa U.S.A.) leaf tissue harvested 45 and 55 days post-flowering. Leaves from field grown plants are harvested 45 and 55 days after flowering from the fourth node. Approximately 27 g and 33 g of seeds are harvested from the respective seed pods and immediately frozen in dry ice. The harvested tissue is then stored at −80° C. until RNA preparation.

The SOYMON019 cDNA library is generated from soybean cultivars Cristalina (USDA Soybean Germplasm Collection, Urbana, Ill. U.S.A.) and FT108 (Monsoy, Brazil) (tropical germ plasma) root tissue. Roots are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 50 g and 56 g of roots are harvested from each of the Cristalina and FT108 cultivars and immediately frozen in dry ice. The harvested tissue is then stored at −80° C. until RNA preparation.

The SOYMON020 cDNA is generated from soybean cultivar Asgrow 3244 (Asgrow Seed Company, Des Moines, Iowa U.S.A.) seed tissue harvested 65 and 75 days post-flowering. Seed pods from field grown plants are harvested 45 and 55 days after flowering and the seeds extracted from the pods. Approximately 14 g and 31 g of seeds are harvested from the respective seed pods and immediately frozen in dry ice. The harvested tissue is then stored at −80° C. until RNA preparation.

The SOYMON021 cDNA library is generated from Soybean Cyst Nematode-resistant soybean cultivar Hartwig (USDA Soybean Germplasm Collection, Urbana, Ill. U.S.A.) root tissue. Plants are grown in tissue culture at room temperature. At approximately 6 weeks post-germination, the plants are exposed to sterilized Soybean Cyst Nematode eggs. Infection is then allowed to progress for 10 days. After the 10 day infection process, the tissue is harvested. Agar from the culture medium and nematodes are removed and the root tissue is immediately frozen in dry ice. The harvested tissue is then stored at −80° C. until RNA preparation.

The SOYMON022 (Lib3030) cDNA library is generated from soybean cultivar Asgrow 3244 (Asgrow Seed Company, Des Moines, Iowa U.S.A.) partially opened flower tissue. Partially to fully opened flower tissue is harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. A total of 3 g of flower tissue is harvested and immediately frozen in dry ice. The harvested tissue is then stored at −80° C. until RNA preparation.

The SOYMON023 cDNA library is generated from soybean genotype BW211S Null (Tohoku University, Morioka, Japan) seed tissue harvested 15 and 40 days post-flowering. Seed pods from field grown plants are harvested 15 and 40 days post-flowering and the seeds extracted from the pods. Approximately 0.7 g and 14.2 g of seeds are harvested from the respective seed pods and immediately frozen in dry ice. The harvested tissue is then stored at −80° C. until RNA preparation.

The SOYMON024 cDNA library is generated from soybean cultivar Asgrow 3244 (Asgrow Seed Company, Des Moines, Iowa U.S.A.) internode-2 tissue harvested 18 days post-imbibition. Seeds are planted at a depth of approximately 2 cm into 2-3 inch peat pots containing Metromix 350 medium. The plants are grown in a greenhouse for 18 days after the start of imbibition at ambient temperature. Soil is checked and watered daily to maintain even moisture conditions. Stem tissue is harvested 18 days after the start of imbibition. The samples are divided into hypocotyl and internodes 1 through 5. The fifth internode contains some leaf bud material. Approximately 3 g of each sample is harvested and immediately frozen in dry ice. The harvested tissue is then stored at −80° C. until RNA preparation.

The SOYMON025 cDNA library is generated from soybean cultivar Asgrow 3244 (Asgrow Seed Company, Des Moines, Iowa U.S.A.) leaf tissue harvested 65 days post-flowering. Leaves are harvested from the fourth node of field grown plants 65 days post-flowering. Approximately 18.4 g of leaf tissue is harvested and immediately frozen in dry ice. The harvested tissue is then stored at −80° C. until RNA preparation.

SOYMON026 cDNA library is generated from soybean cultivar Asgrow 3244 (Asgrow Seed Company, Des Moines, Iowa U.S.A.) root tissue harvested 65 and 75 days post-flowering. Approximately 27 g and 40 g of root tissue from field grown plants is harvested 65 and 75 days post-flowering. The root system is cut from the soybean plant, washed with water to free it from the soil and immediately frozen in dry-ice. The harvested tissue is then stored at −80° C. until RNA preparation.

The SOYMON027 cDNA library is generated from soybean cultivar Asgrow 3244 (Asgrow Seed Company, Des Moines, Iowa U.S.A.) seed tissue harvested 25 days post-flowering. Seed pods from field grown plants are harvested 25 days post-flowering and the seeds extracted from the pods. Approximately 17 g of seeds are harvested from the seed pods and immediately frozen in dry ice. The harvested tissue is then stored at −80° C. until RNA preparation.

The SOYMON028 cDNA library is generated from soybean cultivar Asgrow 3244 (Asgrow Seed Company, Des Moines, Iowa U.S.A.) drought-stressed root tissue. The plants are grown in an environmental chamber under 12 hr daytime/12 hr nighttime cycles. The daytime temperature is approximately 29° C. and the nighttime temperature 24° C. Soil is checked and watered daily to maintain even moisture conditions. At the R3 stage of development, water is withheld from half of the plant collection (drought stressed population). After 3 days, half of the plants from the drought stressed condition and half of the plants from the control population are harvested. After another 3 days (6 days post drought induction) the remaining plants are harvested. A total of 27 g and 40 g of root tissue is harvested and immediately frozen in dry ice. The harvested tissue is then stored at −80° C. until RNA preparation.

The SOYMON029 cDNA library is generated from Soybean Cyst Nematode-resistant soybean cultivar PI07354 (USDA Soybean Germplasm Collection, Urbana, Ill. U.S.A.) root tissue. Late fall to early winter greenhouse grown plants are exposed to Soybean Cyst Nematode eggs. At 10 days post-infection, the plants are uprooted, rinsed briefly and the roots frozen in liquid nitrogen. Approximately 20 grams of root tissue is harvested from the infected plants. The harvested tissue is then stored at −80° C. until RNA preparation.

The SOYMON030 cDNA library is generated from soybean cultivar Asgrow 3244 (Asgrow Seed Company, Des Moines, Iowa U.S.A.) flower bud tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature approximately 24° C. Soil is checked and watered daily to maintain even moisture conditions. Flower buds are removed from the plant at the pedicel. A total of 100 mg of flower buds are harvested and immediately frozen in liquid nitrogen. The harvested tissue is then stored at −80° C. until RNA preparation.

The SOYMON031 cDNA library is generated from soybean cultivar Asgrow 3244 (Asgrow Seed Company, Des Moines, Iowa U.S.A.) carpel and stamen tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature approximately 24° C. Soil is checked and watered daily to maintain even moisture conditions. Flower buds are removed from the plant at the pedicel. Flowers are dissected to separate petals, sepals and reproductive structures (carpels and stamens). A total of 300 mg of carpel and stamen tissue are harvested and immediately frozen in liquid nitrogen. The harvested tissue is then stored at −80° C. until RNA preparation.

The SOYMON032 cDNA library is prepared from the Asgrow cultivar A4922 (Asgrow Seed Company, Des Moines, Iowa U.S.A.) rehydrated dry soybean seed meristem tissue. Surface sterilized seeds are germinated in liquid media for 24 hours. The seed axis is then excised from the barely germinating seed, placed on tissue culture media and incubated overnight at 20° C. in the dark. The supportive tissue is removed from the explant prior to harvest. Approximately 570 mg of tissue is harvested and frozen in liquid nitrogen. The harvested tissue is then stored at −80° C. until RNA preparation.

The SOYMON033 cDNA library is generated from soybean cultivar Asgrow 3244 (Asgrow Seed Company, Des Moines, Iowa U.S.A.) heat-shocked seedling tissue without cotyledons. Seeds are imbibed and germinated in vermiculite for 2 days under constant illumination. After 48 hours, the seedlings are transferred to an incubator set at 40° C. under constant illumination. After 30, 60 and 180 minutes seedlings are harvested and dissected. A portion of the seedling consisting of the root, hypocotyl and apical hook is frozen in liquid nitrogen and stored at −80° C. The seedlings after 2 days of imbibition are beginning to emerge from the vermiculite surface. The apical hooks are dark green in appearance. Total RNA and poly A+ RNA is prepared from equal amounts of pooled tissue.

The SOYMON034 cDNA library is generated from soybean cultivar Asgrow 3244 (Asgrow Seed Company, Des Moines, Iowa U.S.A.) cold-shocked seedling tissue without cotyledons. Seeds are imbibed and germinated in vermiculite for 2 days under constant illumination. After 48 hours, the seedlings are transferred to a cold room set at 5° C. under constant illumination. After 30, 60 and 180 minutes seedlings are harvested and dissected. A portion of the seedling consisting of the root, hypocotyl and apical hook is frozen in liquid nitrogen and stored at −80° C. The seedlings after 2 days of imbibition are beginning to emerge from the vermiculite surface. The apical hooks are dark green in appearance.

The SOYMON035 cDNA library is generated from soybean cultivar Asgrow 3244 (Asgrow Seed Company, Des Moines, Iowa U.S.A.) seed coat tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Seeds are harvested from mid to nearly full maturation (seed coats are not yellowing). The entire embryo proper is removed from the seed coat sample and the seed coat tissue are harvested and immediately frozen in liquid nitrogen. The harvested tissue is then stored at −80° C. until RNA preparation.

The SOYMON036 cDNA library is generated from soybean cultivars PI171451, PI227687 and PI229358 (USDA Soybean Germplasm Collection, Urbana, Ill. U.S.A.) insect challenged leaves. Plants from each of the three cultivars are grown in screenhouse conditions. The screenhouse is divided in half and one half of the screenhouse is infested with soybean looper and the other half infested with velvetbean caterpillar. A single leaf is taken from each of the representative plants at 3 different time points, 11 days after infestation, 2 weeks after infestation and 5 weeks after infestation and immediately frozen in liquid nitrogen. The harvested tissue is then stored at −80° C. until RNA preparation. Total RNA and poly A+ RNA is isolated from pooled tissue consisting of equal quantities of all 18 samples (3 genotypes×3 sample times×2 insect genotypes).

The SOYMON037 cDNA library is generated from soybean cultivar A3244 (Asgrow Seed Company, Des Moines, Iowa U.S.A.) etiolated axis and radical tissue. Seeds are planted in moist vermiculite, wrapped and kept at room temperature in complete darkness until harvest. Etiolated axis and hypocotyl tissue is harvested at 2, 3 and 4 days postplanting. A total of 1 gram of each tissue type is harvested at 2, 3 and 4 days after planting and immediately frozen in liquid nitrogen. The harvested tissue is then stored at −80° C. until RNA preparation.

The SOYMON038 cDNA library is generated from soybean variety Asgrow A3237 (Asgrow Seed Company, Des Moines, Iowa U.S.A.) rehydrated dry seeds. Explants are prepared for transformation after germination of surface-sterilized seeds on solid tissue media. After 6 days, at 28° C. and 18 hours of light per day, the germinated seeds are cold shocked at 4° C. for 24 hours. Meristemic tissue and part of the hypocotyl is remove and cotyledon excised. The prepared explant is then wounded for *Agrobacterium* infection. The 2 grams of harvested tissue is frozen in liquid nitrogen and stored at −80° C. until RNA preparation.

The Soy51 (LIB3027) cDNA library is prepared from equal amounts tissue harvested from SOYMON007, SOYMON015 and SOYMON020 prepared tissue. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are converted to double stranded form and represent the primary normalized library.

The Soy52 (LIB3028) cDNA library is generated from normalized flower DNA. Single stranded DNA representing approximately 1×10⁶ colony forming units of SOYMON022 harvested tissue is used as the starting material for normalization. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are converted to double stranded form and represent the primary normalized library.

The Soy53 (LIB3039) cDNA library is generated from soybean cultivar Asgrow 3244 (Asgrow Seed Company, Des Moines, Iowa U.S.A.) seedling shoot apical meristem tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Apical tissue is harvested from seedling shoot meristem tissue, 7-8 days after the start of imbibition. The apex of each seedling is dissected to include the fifth node to the apical meristem. The fifth node corresponds to the third trifoliate leaf in the very early stages of development. Stipules completely envelop the leaf primordia at this time. A total of 200 mg of apical tissue is harvested and immediately frozen in liquid nitrogen. The harvested tissue is then stored at −80° C. until RNA preparation.

The Soy54 (LIB3040) cDNA library is generated from soybean cultivar Asgrow 3244 (Asgrow Seed Company, Des Moines, Iowa U.S.A.) heart to torpedo stage embryo tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Seeds are collected and embryos removed from surrounding endosperm and maternal tissues. Embryos from globular to young torpedo stages (by corresponding analogy to *Arabidopsis*) are collected with a bias towards the middle of this spectrum. Embryos which are beginning to show asymmetric development of cotyledons are considered the upper developmental boundary for the collection and are excluded. A total of 12 mg embryo tissue is frozen in liquid nitrogen. The harvested tissue is stored at −80° C. until RNA preparation.

Soy55 (LIB3049) cDNA library is generated from soybean cultivar Asgrow 3244 (Asgrow Seed Company, Des Moines, Iowa U.S.A.) young seed tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Seeds are collected from very young pods (5 to 15 days after flowering). A total of 100 mg of seeds are harvested and frozen in liquid nitrogen. The harvested tissue is stored at −80° C. until RNA preparation.

Soy56 (LIB3029) cDNA library is prepared from equal amounts tissue harvested from SOYMON007, SOYMON015 and SOYMON020 prepared tissue. Single stranded and double stranded DNA representing approximately 1×10⁶ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are not converted to double stranded form and represent a non-normalized seed pool for comparison to Soy51 cDNA libraries.

The Soy58 (LIB3050) cDNA library is generated from soybean cultivar Asgrow 3244 (Asgrow Seed Company, Des Moines, Iowa U.S.A.) drought stressed root tissue subtracted from control root tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. At the R3 stage of the plant drought is induced by withholding water. After 3 and 6 days root tissue from both drought stressed and control (watered regularly) plants are collected and frozen in dry-ice. The harvested tissue is stored at −80° C. until RNA preparation. For subtraction, target cDNA is made from the drought stressed tissue total RNA using the SMART cDNA synthesis system from Clonetech (Clonetech Laboratories, Palo Alto, Calif. U.S.A.). Driver first strand cDNA is covalently linked to Dynabeads following a protocol similar to that described in the Dynal literature (Dynabeads, Dynal Corporation, Lake Success, N.Y. U.S.A.). The target cDNA is then heat denatured and the second strand trapped using Dynabeads oligo-dT. The target second strand cDNA is then hybridized to the driver cDNA in 400 1 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with Dynabeads oligo-dT. The trapped cDNA is then amplified as in previous PCR based libraries and the resulting cDNA ligated into the pSPORT vector (Invitrogen, Carlsbad, Calif. U.S.A.).

The Soy59 (LIB3051) cDNA library is generated from soybean cultivar Asgrow 3244 (Asgrow Seed Company, Des Moines, Iowa U.S.A.) endosperm tissue. Seeds are germinated on paper towels under laboratory ambient light conditions. At 8, 10 and 14 hours after imbibition, the seed coats are harvested. The endosperm consists of a very thin layer of tissue affixed to the inside of the seed coat. The seed coat and endosperm are frozen immediately after harvest in liquid nitrogen. The harvested tissue is stored at −80° C. until RNA preparation.

The Soy60 (LIB3072) cDNA library is generated from soybean cultivar Asgrow 3244 (Asgrow Seed Company, Des Moines, Iowa U.S.A.) drought stressed seed plus pod subtracted from control seed plus pod tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 26° C. and the nighttime temperature 21° C. and 70% relative humidity. Soil is checked and watered daily to maintain even moisture conditions. At the R3 stage of the plant drought is induced by withholding water. After 3 and 6 days seeds and pods from both drought stressed and control (watered regularly) plants are collected from the fifth and sixth node and frozen in dry-ice. The harvested tissue is stored at −80° C. until RNA preparation. For subtraction, target cDNA is made from the drought stressed tissue total RNA using the SMART cDNA synthesis system from Clonetech (Clonetech Laboratories, Palo Alto, Calif. U.S.A.). Driver first strand cDNA is covalently linked to Dynabeads following a protocol similar to that described in the Dynal literature (Dynabeads, Dynal Corporation, Lake Success, N.Y. U.S.A.). The target cDNA is then heat denatured and the second strand trapped using Dynabeads oligo-dT. The target second strand cDNA is then hybridized to the driver cDNA in 400 1 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with Dynabeads oligo-dT. The trapped cDNA is then amplified as in previous PCR based libraries and the resulting cDNA ligated into the pSPORT vector (Invitrogen, Carlsbad, Calif. U.S.A.).

The Soy61 (LIB3073) cDNA library is generated from soybean cultivar Asgrow 3244 (Asgrow Seed Company, Des Moines, Iowa U.S.A.) jasmonic acid treated seedling subtracted from control tissue. Seeds are planted at a depth of approximately 2 cm into 2-3 inch peat pots containing Metromix 350 medium and the plants are grown in a greenhouse. The daytime temperature is approximately 29.4° C. and the nighttime temperature 20° C. Soil is checked and watered daily to maintain even moisture conditions. At 9 days post planting, the plantlets are sprayed with either control buffer of 0.1% Tween-20 or jasmonic acid (Sigma J-2500, Sigma, St. Louis, Mo. U.S.A.) at 1 mg/ml in 0.1% Tween-20. Plants are sprayed until runoff and the soil and the stem is soaked with the spraying solution. At 18 hours post application of jasmonic acid, the soybean plantlets appear growth retarded. After 18 hours, 24 hours and 48 hours post treatment, the cotyledons are removed and the remaining leaf and stem tissue above the soil is harvested and frozen in liquid nitrogen. The harvested tissue is stored at −80° C. until RNA preparation. To make RNA, the three sample timepoints were combined and ground. For subtraction, target cDNA is made from the jasmonic acid treated tissue total RNA using the SMART cDNA synthesis system from Clonetech (Clonetech Laboratories, Palo Alto, Calif. U.S.A.). Driver first strand cDNA is covalently linked to Dynabeads following a protocol similar to that described in the Dynal literature (Dynabeads, Dynal Corporation, Lake Success, N.Y. U.S.A.). The target cDNA is then heat denatured and the second strand trapped using Dynabeads oligo-dT. The target second strand cDNA is then hybridized to the driver cDNA in 400 1 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with Dynabeads oligo-dT. The trapped cDNA is then amplified as in previous PCR based libraries and the resulting cDNA ligated into the pSPORT vector (Invitrogen, Carlsbad, Calif. U.S.A.). For this library's construction, the eighth fraction of the cDNA size fractionation step was used for ligation.

The Soy62 (LIB3074) cDNA library is generated from soybean cultivar Asgrow 3244 (Asgrow Seed Company, Des Moines, Iowa U.S.A.) jasmonic acid treated seedling subtracted from control tissue. Seeds are planted at a depth of approximately 2 cm into 2-3 inch peat pots containing Metromix 350 medium and the plants are grown in a greenhouse. The daytime temperature is approximately 29.4° C. and the nighttime temperature 20° C. Soil is checked and watered daily to maintain even moisture conditions. At 9 days post planting, the plantlets are sprayed with either control buffer of 0.1% Tween-20 or jasmonic acid (Sigma J-2500, Sigma, St. Louis, Mo. U.S.A.) at 1 mg/ml in 0.1% Tween-20. Plants are sprayed until runoff and the soil and the stem is soaked with the spraying solution. At 18 hours post application of jasmonic acid, the soybean plantlets appear growth retarded. After 18 hours, 24 hours and 48 hours post treatment, the cotyledons are removed and the remaining leaf and stem tissue above the soil is harvested and frozen in liquid nitrogen. The harvested tissue is stored at −80° C. until RNA preparation. To make RNA, the three sample timepoints were combined and ground. For subtraction, target cDNA is made from the jasmonic acid treated tissue total RNA using the SMART cDNA synthesis system from Clonetech (Clonetech Laboratories, Palo Alto, Calif. U.S.A.). Driver first strand cDNA is covalently linked to Dynabeads following a protocol similar to that described in the Dynal literature (Dynabeads, Dynal Corporation, Lake Success, N.Y. U.S.A.). The target cDNA is then heat denatured and the second strand trapped using Dynabeads oligo-dT. The target second strand cDNA is then hybridized to the driver cDNA in 400 1 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with Dynabeads oligo-dT. The trapped cDNA is then amplified as in previous PCR based libraries and the resulting cDNA ligated into the pSPORT vector (Invitrogen, Carlsbad, Calif. U.S.A.). For this library's construction, the ninth fraction of the cDNA size fractionation step was used for ligation.

The Soy65 (LIB3107) 07cDNA library is generated from soybean cultivar Asgrow 3244 (Asgrow Seed Company, Des Moines, Iowa U.S.A.) drought-stressed abscission zone tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Plants are irrigated with 15-16-17 Peter's Mix. At the R3 stage of development, drought is imposed by withholding water. At 3, 4, 5 and 6 days, tissue is harvested and wilting is not obvious until the fourth day. Abscission layers from reproductive organs are harvested by cutting less than one millimeter proximal and distal to the layer and immediately frozen in liquid nitrogen. The harvested tissue is stored at −80° C. until RNA preparation.

The Soy66 (LIB3109) cDNA library is generated from soybean cultivar Asgrow 3244 (Asgrow Seed Company, Des Moines, Iowa U.S.A.) non-drought stressed abscission zone tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature approximately 24° C. Soil is checked and watered daily to maintain even moisture conditions. Plants are irrigated with 15-16-17 Peter's Mix. At 3, 4, 5 and 6 days, control abscission layer tissue is harvested. Abscission layers from reproductive organs are harvested by cutting less than one millimeter proximal and distal to the layer and immediately frozen in liquid nitrogen. The harvested tissue is stored at −80° C. until RNA preparation.

Soy67 (LIB3065) cDNA library is prepared from equal amounts tissue harvested from SOYMON007, SOYMON015 and SOYMON020 prepared tissue. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. Captured hybrids are eluted with water.

Soy68 (LIB3052) cDNA library is prepared from equal amounts tissue harvested from SOYMON007, SOYMON015 and SOYMON020 prepared tissue. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. Captured hybrids are eluted with water.

Soy69 (LIB3053) cDNA library is generated from soybean cultivars Cristalina (USDA Soybean Germplasm Collection, Urbana, Ill. U.S.A.) and FT108 (Monsoy, Brazil) (tropical germ plasma) normalized leaf tissue. Leaves are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 30 g of leaves are harvested from the $4^{th}$ node of each of the Cristalina and FT108 cultivars and immediately frozen in dry ice. The harvested tissue is then stored at −80° C. until RNA preparation. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are converted to double stranded form and represent the primary normalized library.

Soy70 (LIB3055) cDNA library is generated from soybean cultivars Cristalina (USDA Soybean Germplasm Collection, Urbana, Ill. U.S.A.) and FT108 (Monsoy, Brazil) (tropical germ plasma) leaf tissue. Leaves are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 30 g of leaves are harvested from the $4^{th}$ node of each of the Cristalina and FT108 cultivars and immediately frozen in dry ice. The harvested tissue is then stored at −80° C. until RNA preparation.

Soy71 (LIB3056) cDNA library is generated from soybean cultivars Cristalina and FT108 (tropical germ plasma) root tissue. Roots are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 50 g and 56 g of roots are harvested from each of the Cristalina and FT108 cultivars and immediately frozen in dry ice. The harvested tissue is then stored at −80° C. until RNA preparation.

Soy72 (LIB3093) cDNA library is generated from soybean cultivar Asgrow 3244 (Asgrow Seed Company, Des Moines, Iowa U.S.A.) drought stressed leaf control tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 26° C. and the nighttime temperature 21° C. and 70% relative humidity. Soil is checked and watered daily to maintain even moisture conditions. At the R3 stage of the plant drought is induced by withholding water. After 3 and 6 days seeds and pods from both drought stressed and control (watered regularly) plants are collected from the fifth and sixth node and frozen in dry-ice. The harvested tissue is stored at −80° C. until RNA preparation. For subtraction, target cDNA is made from the drought stressed tissue total RNA using the SMART cDNA synthesis system from Clonetech (Clonetech Laboratories, Palo Alto, Calif. U.S.A.). Driver first strand cDNA is covalently linked to Dynabeads following a protocol similar to that described in the Dynal literature (Dynabeads, Dynal Corporation, Lake Success, N.Y. U.S.A.). The target cDNA is then heat denatured and the second strand trapped using Dynabeads oligo-dT. The target second strand cDNA is then hybridized to the driver cDNA in 400 1 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with Dynabeads oligo-dT. The trapped cDNA is then amplified as in previous PCR based libraries and the resulting cDNA ligated into the pSPORT vector (Invitrogen, Carlsbad, Calif. U.S.A.).

Soy73 (LIB3093) cDNA library is generated from soybean cultivar Asgrow 3244 (Asgrow Seed Company, Des Moines, Iowa U.S.A.) drought stressed leaf subtracted from control tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 26° C. and the nighttime temperature 21° C. and 70% relative humidity. Soil is checked and watered daily to maintain even moisture conditions. At the R3 stage of the plant drought is induced by withholding water. After 3 and 6 days seeds and pods from both drought stressed and control (watered regularly) plants are collected from the fifth and sixth node and frozen in dry-ice. The harvested tissue is stored at −80° C. until RNA preparation. For subtraction, target cDNA is made from the drought stressed tissue total RNA using the SMART cDNA synthesis system from Clonetech (Clonetech Laboratories, Palo Alto, Calif. U.S.A.). Driver first strand cDNA is covalently linked to Dynabeads following a protocol similar to that described in the Dynal literature (Dynabeads, Dynal Corporation, Lake Success, N.Y. U.S.A.). The target cDNA is then heat denatured and the second strand trapped using Dynabeads oligo-dT. The target second strand cDNA is then hybridized to the driver cDNA in 400 l 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with Dynabeads oligo-dT. The trapped cDNA is then amplified as in previous PCR based libraries and the resulting cDNA ligated into the pSPORT vector (Invitrogen, Carlsbad, Calif. U.S.A.).

The Soy76 (Lib3106) cDNA library is generated from soybean cultivar Asgrow 3244 (Asgrow Seed Company, Des Moines, Iowa U.S.A.) jasmonic acid and arachidonic treated seedling subtracted from control tissue. Seeds are planted at a depth of approximately 2 cm into 2-3 inch peat pots containing Metromix 350 medium and the plants are grown in a greenhouse. The daytime temperature is approximately 29.4° C. and the nighttime temperature 20° C. Soil is checked and watered daily to maintain even moisture conditions. At 9 days post planting, the plantlets are sprayed with either control buffer of 0.1% Tween-20 or jasmonic acid (Sigma J-2500, Sigma, St. Louis, Mo. U.S.A.) at 1 mg/ml in 0.1% Tween-20. Plants are sprayed until runoff and the soil and the stem is soaked with the spraying solution. At 18 hours post application of jasmonic acid, the soybean plantlets appear growth retarded. Arachidonic treated seedlings are sprayed with 1 m/ml arachidonic acid in 0.1% Tween-20. After 18 hours, 24 hours and 48 hours post treatment, the cotyledons are removed and the remaining leaf and stem tissue above the soil is harvested and frozen in liquid nitrogen. The harvested tissue is stored at −80° C. until RNA preparation. To make RNA, the three sample timepoints were combined and ground. The RNA from the arachidonic treated seedlings is isolated separately. For subtraction, target cDNA is made from the jasmonic acid treated tissue total RNA using the SMART cDNA synthesis system from Clonetech (Clonetech Laboratories, Palo Alto, Calif. U.S.A.). Driver first strand cDNA is covalently linked to Dynabeads following a protocol similar to that described in the Dynal literature (Dynabeads, Dynal Corporation, Lake Success, N.Y. U.S.A.). The target cDNA is then heat denatured and the second strand trapped using Dynabeads oligo-dT. The target second strand cDNA is then hybridized to the driver cDNA in 400 l 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with Dynabeads oligo-dT. The trapped cDNA is then amplified as in previous PCR based libraries and the resulting cDNA ligated into the pSPORT vector (Invitrogen, Carlsbad, Calif. U.S.A.). Fraction 10 of the size fractionated cDNA is ligated into the pSPORT vector (Invitrogen, Carlsbad, Calif. U.S.A.) in order to capture some of the smaller transcripts characteristic of antifungal proteins.

Soy77 (LIB3108) cDNA library is generated from soybean cultivar Asgrow 3244 (Asgrow Seed Company, Des Moines, Iowa U.S.A.) jasmonic acid control tissue. Seeds are planted at a depth of approximately 2 cm into 2-3 inch peat pots containing Metromix 350 medium and the plants are grown in a greenhouse. The daytime temperature is approximately 29.4° C. and the nighttime temperature 20° C. Soil is checked and watered daily to maintain even moisture conditions. At 9 days post planting, the plantlets are sprayed with either control buffer of 0.1% Tween-20 or jasmonic acid (Sigma J-2500, Sigma, St. Louis, Mo. U.S.A.) at 1 mg/ml in 0.1% Tween-20. Plants are sprayed until runoff and the soil and the stem is soaked with the spraying solution. At 18 hours post application of jasmonic acid, the soybean plantlets appear growth retarded. Arachidonic treated seedlings are sprayed with 1 m/ml arachidonic acid in 0.1% Tween-20. After 18 hours, 24 hours and 48 hours post treatment, the cotyledons are removed and the remaining leaf and stem tissue above the soil is harvested and frozen in liquid nitrogen. The harvested tissue is stored at −80° C. until RNA preparation. To make RNA, the three sample timepoints were combined and ground. The RNA from the arachidonic treated seedlings is isolated separately. For subtraction, target cDNA is made from the jasmonic acid treated tissue total RNA using the SMART cDNA synthesis system from Clonetech (Clonetech Laboratories, Palo Alto, Calif. U.S.A.). Driver first strand cDNA is covalently linked to Dynabeads following a protocol similar to that described in the Dynal literature (Dynabeads, Dynal Corporation, Lake Success, N.Y. U.S.A.). The target cDNA is then heat denatured and the second strand trapped using Dynabeads oligo-dT. The target second strand cDNA is then hybridized to the driver cDNA in 400 l 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with Dynabeads oligo-dT. The trapped cDNA is then amplified as in previous PCR based libraries and the resulting cDNA ligated into the pSPORT vector (Invitrogen, Carlsbad, Calif. U.S.A.). Fraction 10 of the size fractionated cDNA is ligated into the pSPORT vector in order to capture some of the smaller transcripts characteristic of antifungal proteins.

The Lib9 cDNA library is prepared from *Arabidopsis thaliana*, Columbia ecotype, leaf tissue. Wild type *Arabidopsis thaliana* seeds are planted in commonly used planting pots and grown in an environmental chamber. Leaf blades were cut with sharp scissors at seven weeks after planting. The tissue was immediately frozen in liquid nitrogen. The harvested tissue is stored at −80° C. until RNA extraction. PolyA mRNA is purified from the total RNA preparation using Dynabeads® Oligo(dT)$_{25}$ (Dynal Inc., Lake Success, N.Y.), or equivalent methods. This library was normalized using a PCR-based protocol.

The Lib22 cDNA library is prepared from *Arabidopsis thaliana* Columbia ecotype, root tissue. Wild type *Arabidopsis thaliana* seeds are planted in commonly used planting pots and grown in an environmental chamber. After 5-6 weeks the plants are in the reproductive growth phase. Stems are bolting from the base of the plants. After 7 weeks, more stems, floral buds appear, and a few flowers are starting to open. The 7-week old plants are rinsed intensively by tope water remove dirt from the roots, and blotted by paper towel. The tissues are immediately frozen in liquid nitrogen. The harvested tissue is stored at −80° C. until RNA preparation.

The Lib23 cDNA library is prepared from *Arabidopsis thaliana*, Columbia ecotype, stem tissue. Wild type *Arabidopsis thaliana* seeds are planted in commonly used planting pots and grown in an environmental chamber. Stems were collected seven to eight weeks after planting by cutting the stems from the base and cutting the top of the plant to remove the floral tissue. The tissue was immediately frozen in liquid nitrogen and stored at −80° C. until total RNA extraction. PolyA mRNA is purified from the total RNA preparation using Dynabeads® Oligo(dT)$_{25}$ (Dynal Inc., Lake Success, N.Y.), or equivalent methods. This library was normalized using a PCR-based protocol.

The Lib24 cDNA library is prepared from *Arabidopsis thaliana*, Columbia ecotype, flower bud tissue. Wild type *Arabidopsis thaliana* seeds are planted in commonly used planting pots and grown in an environmental chamber. Flower buds are green and unopened and harvested about seven weeks after planting. The tissue is immediately frozen in liquid nitrogen. The harvested tissue is stored at −80° C. until total RNA extraction. PolyA mRNA is purified from the total RNA preparation using Dynabeads® Oligo(dT)$_{25}$ (Dynal Inc., Lake Success, N.Y.), or equivalent methods. This library was normalized using a PCR-based protocol.

The Lib25 cDNA library is prepared from *Arabidopsis thaliana*, Columbia ecotype, open flower tissue. Wild type *Arabidopsis thaliana* seeds are planted in commonly used planting pots and grown in an environmental chamber. Flowers are completely opened with all parts of floral structure observable, but no siliques are appearing. The tissue was immediately frozen in liquid nitrogen and stored at −80° C. until total RNA extraction. PolyA mRNA is purified from the total RNA preparation using Dynabeads® Oligo(dT)$_{25}$ (Dynal Inc., Lake Success, N.Y.), or equivalent methods. This library was normalized using a PCR-based protocol.

The Lib35 cDNA library of the present invention, was prepared from *Arabidopsis thaliana* Columbia ecotype leaf tissue. Wild type *Arabidopsis thaliana* seeds are planted in commonly used planting pots and grown in an environmental chamber. After 5-6 weeks the plants are in the reproductive growth phase. Stems are bolting from the base of the plants. After 7 weeks, more stems and floral buds appeared and a few flowers were starting to open. Leaf blades were collected by cutting with sharp scissors. The tissues were immediately frozen in liquid nitrogen and stored at −80° C. until use. PolyA mRNA is purified from the total RNA preparation using Dynabeads® Oligo(dT)$_{25}$ (Dynal Inc., Lake Success, N.Y.), or equivalent methods. This library was normalized using a PCR-based protocol.

The Lib146 cDNA library is prepared from *Arabidopsis thaliana*, Columbia ecotype, immature seed tissue. Wild type *Arabidopsis thaliana* seeds are planted in commonly used planting pots and grown in an environmental chamber. At approximately 7-8 weeks of age, the seeds are harvested. The seeds ranged in maturity from the smallest seeds that could be dissected from silques to just before starting to turn yellow in color. The tissue is immediately frozen in liquid nitrogen. The harvested tissue is stored at −80° C. until RNA extraction. PolyA mRNA is purified from the total RNA preparation using Dynabeads® Oligo(dT)$_{25}$ (Dynal Inc., Lake Success, N.Y.), or equivalent methods. This library is normalized using a PCR-based protocol.

The Lib3032 (Lib80) cDNA libraries are generated from *Brassica napus* seeds harvested 30 days after pollination. The cDNA libraries are constructed using the SuperScript Plasmid system for cDNA synthesis and plasmid cloning (Life Technologies, Gaithersgurg, Md. U.S.A.) according to the manufacturers protocol with the following modification: 40 micrograms of total RNA is used as the starting material for cDNA synthesis, and first strand cDNA synthesis is carried out at 45° C.

The Lib3034 (Lib82) cDNA libraries are generated from *Brassica napus* seeds harvested 15 and 18 days after pollination. The cDNA libraries are constructed using the SuperScript Plasmid system for cDNA synthesis and plasmid cloning (Life Technologies, Gaithersburg, Md. U.S.A.) according to the manufacturers protocol with the following modification: 40 micrograms of total RNA is used as the starting material for cDNA synthesis, and first strand cDNA synthesis was carried out at 45° C.

The Lib3099 cDNA library is generated by a subtraction procedure. The library contains cDNAs whose abundance is enriched in the *Brassica napus* 15 and 18 day after pollination seed tissues when compared to *Brassica* leaf tissues. The cDNA synthesis is performed on Brassica leaf RNA and *Brassica* RNA isolated from seeds harvested 15 and 18 days after pollination using a Smart PCR cDNA synthesis kit according to the manufacturers protocol (Clontech, Palo Alto, Calif. U.S.A.). The subtacted cDNA is generated using the Clontech PCR-Select subtaction kit according to the manufacturers protocol (Clontech, Palo Alto, Calif. U.S.A.). The subtacted cDNA was cloned into plasmid vector pCR2.1 according to the manufacturers protocol (Invitrogen, Carlsbad, Calif. U.S.A.).

The Lib3033 (Lib81) cDNA libraries are generated from from the *Schizochytrium* species cells. The *Schizochytrium* species cells are grown in liquid media until saturation. The culture is centrifuged to pellet the cells, the medium is decanted off, and pellet immediately frozen in liquid nitrogen. Wax esters are produced under such dark, anaerobic, rich-medium conditions. High wax production by the cultures is verified by microscopy (fluorescein staining of wax bodies) and by lipid extraction/TLC/GC. The harvested cells are stored at −80° C. until RNA preparation. RNA is prepared from the frozen *Euglena* cell pellet as follows. The pellet is pulverized to a powder in liquid nitrogen using a mortar and pestle. The powder is transferred to tubes containing 6 ml each of lysis buffer (100 mM Tris, pH 8, 0.6 M NaCl, 10 mM EDTA, and 4% (w/v) SDS) and buffered phenol, vortexed, and disrupted with a Polytron. The mixture is centrifuged 20 min at 10,000×g in Corex glass tubes to separate the phases. 5 ml of the upper phase is removed, vortexed with 5 ml fresh phenol, and centrifuged. The upper phase is removed and the RNA is precipitated overnight at 4° C. by adding 1.5 volumes of 4 M LiCl. The RNA is further purified on Rneasy columns according to the manufacturers protocol (Qiagen, Valencia, Calif. U.S.A.). The cDNA library is constructed using the SuperScript Plasmid system for cDNA synthesis and plasmid cloning (Life Technologies, Gaithersburg, Md. U.S.A.) according to the manufacturers protocol with the following modification: 40 micrograms of total RNA was used as the starting material for cDNA synthesis, and first strand cDNA synthesis was carried out at 45° C.

The Lib47 cDNA library is generated from *Euglena gracilus* strain 753 (ATTC No. 30285, ATCC Manasas, Va. U.S.A.) grown in liquid culture. A liquid culture is innoculated with 1/10 volume of a previously-grown saturated culture, and the new culture for 4 days under near-anaerobic conditions (near-anaerobic cultures are not agitated, just gently swirled once a day) in the dark in 2× Beef (10 g/l bacto peptone, 4 g/l yeast extract, 2 g/l beef extract, 6 g/l glucose). The culture is then centrifuged to pellet the cells, the medium is decanted off, and pellet immediately frozen in liquid nitrogen. Wax esters are produced under such dark, anaerobic, rich-medium conditions. High wax production by the cultures is verified by microscopy (fluorescein staining of wax bodies) and by lipid extraction/TLC/GC. The harvested cells are stored at −80° C. until RNA preparation. RNA is prepared from the frozen *Euglena* cell pellet as follows. The pellet is pulverized to a powder in liquid nitrogen using a mortar and pestle. The powder is transferred to tubes containing 6 ml each of lysis buffer (100 mM Tris, pH 8, 0.6 M NaCl, 10 mM EDTA, and 4% (w/v) SDS) and buffered phenol, vortexed, and disrupted with a Polytron. The mixture is centrifuged 20 min at 10,000×g in Corex glass tubes to separate the phases. 5 ml of the upper phase is removed, vortexed with 5 ml fresh phenol, and centrifuged. The upper phase is removed and the RNA is precipitated overnight at 4° C. by adding 1.5 volumes of 4 M LiCl. The RNA is further purified on Rneasy columns according to the manufacturers protocol (Qiagen, Valencia, Calif.

U.S.A.). The cDNA library is constructed using the SuperScript Plasmid system for cDNA synthesis and plasmid cloning (Life Technologies, Gaithersburg, Md. U.S.A.) according to the manufacturers protocol with the following modification: 40 micrograms of total RNA was used as the starting material for cDNA synthesis, and first strand cDNA synthesis was carried out at 45° C.

The Lib44 cDNA library is generated from *Phaeodactylum tricornatum* grown in modified Jones medium for 3 days. The cells were harvested by centrifugation and the resulting pellet frozen immediately in liquid nitrogen. The harvested cells are stored at −80° C. until RNA preparation. RNA is prepared from the frozen *Phaeodactylum* cell pellet as follows. The pellet is pulverized to a powder in liquid nitrogen using a mortar and pestle. The powder is transferred to tubes containing 6 ml each of lysis buffer (100 mM Tris, pH 8, 0.6 M NaCl, 10 mM EDTA, and 4% (w/v) SDS) and buffered phenol, vortexed, and disrupted with a Polytron. The mixture is centrifuged 20 min at 10,000×g in Corex glass tubes to separate the phases. 5 ml of the upper phase is removed, vortexed with 5 ml fresh phenol, and centrifuged. The upper phase is removed and the RNA is precipitated overnight at 4° C. by adding 1.5 volumes of 4 M LiCl. The RNA is further purified on Rneasy columns according to the manufacturers protocol (Qiagen, Valencia, Calif. U.S.A.). The cDNA library is constructed using the SuperScript Plasmid system for cDNA synthesis and plasmid cloning (Life Technologies, Gaithersburg, Md. U.S.A.) according to the manufacturers protocol with the following modification: 40 micrograms of total RNA was used as the starting material for cDNA synthesis, and first strand cDNA synthesis was carried out at 45 degrees centigrade.

The LIB3036 genomic library is generated from *Mycobacterium neoaurum* US52 (ATCC No. 23072, ATCC, Manasas, Va. U.S.A.) cells. *Mycobacterium neoaurum* US52 is a gram-positive Actinomycete bacterium. *Mycobacterium neoaurum* US52 is genetically related to *Mycobacterium tuberculosis*, but there is no reason to believe that it is a primary pathogen. It normally is saprophytic, i.e. it lives in soil and gets nutrients from decaying matter. Genomic DNA obtained from *Mycobacterium neoaurum* US52 is digested for various times with the restriction enzyme Sau3A. The DNA fractions are size-separated on an agarose gel, and the first fraction wherein most of the partially-digested fragments are about 10 kB is used to isolated fragments in the range of 2-3 kB. For LIB3036, the 2-3 kB DNA is cloned into vector pRY401 (Invitrogen, Carlsbad, Calif. U.S.A.). The vector pZERO-2 (Invitrogen, Carlsbad, Calif. U.S.A.). is used for the construction of LIB3104.

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

Normalized libraries are made using essentially the Soares procedure (Soares et al., *Proc. Natl. Acad. Sci.* (U.S.A.) 91:9228-9232 (1994), the entirety of which is herein incorporated by reference). This approach is designed to reduce the initial 10,000-fold variation in individual cDNA frequencies to achieve abundances within one order of magnitude while maintaining the overall sequence complexity of the library. In the normalization process, the prevalence of high-abundance cDNA clones decreases dramatically, clones with mid-level abundance are relatively unaffected and clones for rare transcripts are effectively increased in abundance.

EXAMPLE 2

The cDNA libraries are plated on LB agar containing the appropriate antibiotics for selection and incubated at 37° for a sufficient time to allow the growth of individual colonies. Single colonies are individually placed in each well of a 96-well microtiter plates containing LB liquid including the selective antibiotics. The plates are incubated overnight at approximately 37° C. with gentle shaking to promote growth of the cultures. The plasmid DNA is isolated from each clone using Qiaprep plasmid isolation kits, using the conditions recommended by the manufacturer (Qiagen Inc., Santa Clara, Calif. U.S.A.).

Template plasmid DNA clones are used for subsequent sequencing. For sequencing, the ABI PRISM dRhodamine Terminator Cycle Sequencing Ready Reaction Kit with AmpliTaq® DNA Polymerase, FS, is used (PE Applied Biosystems, Foster City, Calif. U.S.A.).

EXAMPLE 3

Nucleic acid sequences that encode for the following proteins: triose phosphate isomerase, fructose 1,6-bisphosphate aldolase, fructose 1,6-bisphosphate, fructose 6-phosphate 2-kinase, phosphoglucoisomerase, vacuolar $H^+$ translocating-pyrophosphatase, pyrophosphate-dependent fructose-6-phosphate phosphotransferase, invertase, sucrose synthase, hexokinase, fructokinase, NDP-kinase, glucose-6-phosphate 1-dehydrogenase, phosphoglucomutase and UDP-glucose pyrophophorylase are identified from the Monsanto EST PhytoSeq database using TBLASTN (default values) (TBLASTN compares a protein query against the six reading frames of a nucleic acid sequence). Matches found with BLAST P values equal or less than 0.001 (probability) or BLAST Score of equal or greater than 90 are classified as hits. If the program used to determine the hit is HMMSW then the score refers to HMMSW score.

In addition, the GenBank database is searched with BLASTN and BLASTX (default values) using ESTs as queries. EST that pass the hit probability threshold of $10e^{-8}$ for the following enzymes are combined with the hits generated by using TBLASTN (described above) and classified by enzyme (see Table A below).

A cluster refers to a set of overlapping clones in the PhytoSeq database. Such an overlapping relationship among clones is designated as a "cluster" when BLAST scores from pairwise sequence comparisons of the member clones meets a predetermined minimum value or product score of 50 or more (Product Score=(BLAST SCORE×Percentage Identity)/(5×minimum [length (Seq1), length (Seq2)]))

Since clusters are formed on the basis of single-linkage relationships, it is possible for two non-overlapping clones to be members of the same cluster if, for instance, they both overlap a third clone with at least the predetermined minimum BLAST score (stringency). A cluster ID is arbitrarily assigned to all of those clones which belong to the same cluster at a given stringency and a particular clone will belong to only one cluster at a given stringency. If a cluster contains only a single clone (a "singleton"), then the cluster ID number will be negative, with an absolute value equal to the clone ID number of its single member. Clones grouped in a cluster in most cases represent a contiguous sequence.

TABLE A*

| Seq No. | Cluster ID | CloneID | Library | NCBI gi | Method | Score | P-value | % Ident |
|---|---|---|---|---|---|---|---|---|
| colspan=9 | MAIZE TRIOSE PHOSPHATE ISOMERASE |||||||||

| Seq No. | Cluster ID | CloneID | Library | NCBI gi | Method | Score | P-value | % Ident |
|---|---|---|---|---|---|---|---|---|
| 1 | −700019675 | 700019675H1 | SATMON001 | g546735 | BLASTX | 134 | 1e−11 | 78 |
| 2 | −700073894 | 700073894H1 | SATMON007 | g609261 | BLASTN | 257 | 1e−10 | 84 |
| 3 | −700167260 | 700167260H1 | SATMON013 | g609261 | BLASTN | 644 | 1e−44 | 79 |
| 4 | −700380595 | 700380595H1 | SATMON021 | g609261 | BLASTN | 1121 | 1e−84 | 87 |
| 5 | −700449667 | 700449667H1 | SATMON028 | g217973 | BLASTN | 204 | 1e−18 | 93 |
| 6 | −700449720 | 700449720H2 | SATMON028 | g217973 | BLASTN | 216 | 1e−18 | 88 |
| 7 | −700570661 | 700570661H1 | SATMON030 | g168647 | BLASTX | 131 | 1e−11 | 88 |
| 8 | −700616770 | 700616770H1 | SATMON033 | g407525 | BLASTX | 149 | 1e−13 | 83 |
| 9 | −701170944 | 701170944H1 | SATMONN05 | g217921 | BLASTX | 188 | 1e−20 | 53 |
| 10 | 11337 | 700337974H1 | SATMON020 | g256119 | BLASTN | 535 | 1e−61 | 78 |
| 11 | 11337 | 700027829H1 | SATMON003 | g256119 | BLASTN | 726 | 1e−51 | 80 |
| 12 | 126 | 700050046H1 | SATMON003 | g1785947 | BLASTN | 440 | 1e−26 | 92 |
| 13 | 282 | 700077320H1 | SATMON007 | g217973 | BLASTN | 666 | 1e−108 | 97 |
| 14 | 282 | 700104541H1 | SATMON010 | g217973 | BLASTN | 631 | 1e−106 | 97 |
| 15 | 282 | 700047476H1 | SATMON003 | g217973 | BLASTN | 648 | 1e−105 | 97 |
| 16 | 282 | 700211559H1 | SATMON016 | g217973 | BLASTN | 525 | 1e−104 | 97 |
| 17 | 282 | 700073553H1 | SATMON007 | g217973 | BLASTN | 981 | 1e−103 | 98 |
| 18 | 282 | 700613011H1 | SATMON033 | g217973 | BLASTN | 552 | 1e−102 | 98 |
| 19 | 282 | 700352119H1 | SATMON023 | g217973 | BLASTN | 666 | 1e−101 | 97 |
| 20 | 282 | 700088148H1 | SATMON011 | g217973 | BLASTN | 666 | 1e−100 | 98 |
| 21 | 282 | 700351626H1 | SATMON023 | g217973 | BLASTN | 401 | 1e−99 | 98 |
| 22 | 282 | 700240096H1 | SATMON010 | g217973 | BLASTN | 666 | 1e−98 | 97 |
| 23 | 282 | 700083660H1 | SATMON011 | g217973 | BLASTN | 666 | 1e−97 | 99 |
| 24 | 282 | 700208721H1 | SATMON016 | g217973 | BLASTN | 497 | 1e−96 | 98 |
| 25 | 282 | 700203144H1 | SATMON003 | g217973 | BLASTN | 511 | 1e−96 | 96 |
| 26 | 282 | 700430425H1 | SATMONN01 | g217973 | BLASTN | 666 | 1e−96 | 98 |
| 27 | 282 | 700206091H1 | SATMON003 | g217973 | BLASTN | 497 | 1e−94 | 97 |
| 28 | 282 | 700077017H1 | SATMON007 | g217973 | BLASTN | 614 | 1e−93 | 93 |
| 29 | 282 | 700618792H1 | SATMON034 | g217973 | BLASTN | 546 | 1e−92 | 96 |
| 30 | 282 | 700572532H1 | SATMON030 | g407524 | BLASTN | 1212 | 1e−92 | 84 |
| 31 | 282 | 700106512H1 | SATMON010 | g217973 | BLASTN | 632 | 1e−91 | 97 |
| 32 | 282 | 700195031H1 | SATMON014 | g217973 | BLASTN | 471 | 1e−90 | 97 |
| 33 | 282 | 700168131H1 | SATMON013 | g217973 | BLASTN | 497 | 1e−89 | 98 |
| 34 | 282 | 700197039H1 | SATMON014 | g217973 | BLASTN | 546 | 1e−89 | 98 |
| 35 | 282 | 700572688H1 | SATMON030 | g169820 | BLASTN | 1114 | 1e−89 | 85 |
| 36 | 282 | 700021313H1 | SATMON001 | g217973 | BLASTN | 913 | 1e−87 | 97 |
| 37 | 282 | 700452417H1 | SATMON028 | g217973 | BLASTN | 425 | 1e−86 | 95 |
| 38 | 282 | 700346119H1 | SATMON021 | g217973 | BLASTN | 444 | 1e−86 | 96 |
| 39 | 282 | 700082359H1 | SATMON011 | g217973 | BLASTN | 542 | 1e−86 | 93 |
| 40 | 282 | 700240042H1 | SATMON010 | g217973 | BLASTN | 596 | 1e−86 | 97 |
| 41 | 282 | 700030064H1 | SATMON003 | g217973 | BLASTN | 587 | 1e−85 | 94 |
| 42 | 282 | 700615185H1 | SATMON033 | g217973 | BLASTN | 430 | 1e−84 | 98 |
| 43 | 282 | 700196125H1 | SATMON014 | g217973 | BLASTN | 581 | 1e−84 | 100 |
| 44 | 282 | 700243429H1 | SATMON010 | g217973 | BLASTN | 632 | 1e−84 | 97 |
| 45 | 282 | 700474112H1 | SATMON025 | g217973 | BLASTN | 570 | 1e−83 | 98 |
| 46 | 282 | 700572282H1 | SATMON030 | g407524 | BLASTN | 838 | 1e−83 | 82 |
| 47 | 282 | 700622238H1 | SATMON034 | g169820 | BLASTN | 917 | 1e−80 | 86 |
| 48 | 282 | 700095609H1 | SATMON008 | g169820 | BLASTN | 1067 | 1e−80 | 82 |
| 49 | 282 | 700218886H1 | SATMON011 | g217973 | BLASTN | 551 | 1e−79 | 93 |
| 50 | 282 | 700018688H1 | SATMON001 | g217973 | BLASTN | 1066 | 1e−79 | 99 |
| 51 | 282 | 700049775H1 | SATMON003 | g217973 | BLASTN | 362 | 1e−78 | 91 |
| 52 | 282 | 700575972H1 | SATMON030 | g169820 | BLASTN | 894 | 1e−78 | 79 |
| 53 | 282 | 700215519H1 | SATMON016 | g217973 | BLASTN | 497 | 1e−76 | 97 |
| 54 | 282 | 700161120H1 | SATMON012 | g217973 | BLASTN | 622 | 1e−76 | 98 |
| 55 | 282 | 700581760H1 | SATMON031 | g217973 | BLASTN | 533 | 1e−75 | 90 |
| 56 | 282 | 700104672H1 | SATMON010 | g169820 | BLASTN | 1012 | 1e−75 | 83 |
| 57 | 282 | 700346053H1 | SATMON021 | g169820 | BLASTN | 1012 | 1e−75 | 83 |
| 58 | 282 | 701166592H1 | SATMONN04 | g217973 | BLASTN | 661 | 1e−74 | 95 |
| 59 | 282 | 700968667H1 | SATMONN04 | g217973 | BLASTN | 497 | 1e−73 | 92 |
| 60 | 282 | 700205627H1 | SATMON003 | g217973 | BLASTN | 666 | 1e−73 | 99 |
| 61 | 282 | 700029005H1 | SATMON003 | g169820 | BLASTN | 979 | 1e−72 | 85 |
| 62 | 282 | 700476479H1 | SATMON025 | g169820 | BLASTN | 554 | 1e−71 | 84 |
| 63 | 282 | 700050148H1 | SATMON003 | g169820 | BLASTN | 608 | 1e−70 | 83 |
| 64 | 282 | 700259846H1 | SATMON017 | g217973 | BLASTN | 283 | 1e−69 | 94 |
| 65 | 282 | 700344093H1 | SATMON021 | g169820 | BLASTN | 934 | 1e−69 | 83 |
| 66 | 282 | 700082327H1 | SATMON011 | g169820 | BLASTN | 943 | 1e−69 | 85 |
| 67 | 282 | 700020156H1 | SATMON001 | g217973 | BLASTN | 420 | 1e−68 | 99 |
| 68 | 282 | 700577714H1 | SATMON031 | g169820 | BLASTN | 928 | 1e−68 | 85 |
| 69 | 282 | 700104904H1 | SATMON010 | g169820 | BLASTN | 913 | 1e−67 | 84 |
| 70 | 282 | 700104685H1 | SATMON010 | g169820 | BLASTN | 897 | 1e−66 | 84 |
| 71 | 282 | 700053463H1 | SATMON009 | g169820 | BLASTN | 907 | 1e−66 | 85 |
| 72 | 282 | 700171639H1 | SATMON013 | g217973 | BLASTN | 401 | 1e−65 | 98 |
| 73 | 282 | 700574233H1 | SATMON030 | g169820 | BLASTN | 651 | 1e−65 | 83 |
| 74 | 282 | 700262653H1 | SATMON017 | g169820 | BLASTN | 877 | 1e−64 | 84 |
| 75 | 282 | 700456738H1 | SATMON029 | g169820 | BLASTN | 877 | 1e−64 | 84 |

TABLE A*-continued

| Seq No. | Cluster ID | CloneID | Library | NCBI gi | Method | Score | P-value | % Ident |
|---|---|---|---|---|---|---|---|---|
| 76 | 282 | 700611806H1 | SATMON022 | g169820 | BLASTN | 877 | 1e−64 | 83 |
| 77 | 282 | 700381177H1 | SATMON023 | g169820 | BLASTN | 884 | 1e−64 | 84 |
| 78 | 282 | 700103347H1 | SATMON010 | g169820 | BLASTN | 861 | 1e−63 | 84 |
| 79 | 282 | 700103605H1 | SATMON010 | g169820 | BLASTN | 868 | 1e−63 | 84 |
| 80 | 282 | 700578536H1 | SATMON031 | g169820 | BLASTN | 856 | 1e−62 | 84 |
| 81 | 282 | 700258606H1 | SATMON017 | g169820 | BLASTN | 807 | 1e−61 | 83 |
| 82 | 282 | 700335703H1 | SATMON019 | g217973 | BLASTN | 376 | 1e−60 | 90 |
| 83 | 282 | 700351044H1 | SATMON023 | g169820 | BLASTN | 471 | 1e−59 | 83 |
| 84 | 282 | 700346364H1 | SATMON021 | g169820 | BLASTN | 813 | 1e−59 | 85 |
| 85 | 282 | 700619037H1 | SATMON034 | g169820 | BLASTN | 814 | 1e−59 | 84 |
| 86 | 282 | 700465160H1 | SATMON025 | g169820 | BLASTN | 751 | 1e−57 | 84 |
| 87 | 282 | 700235687H1 | SATMON010 | g169820 | BLASTN | 791 | 1e−57 | 82 |
| 88 | 282 | 700105645H1 | SATMON010 | g169820 | BLASTN | 793 | 1e−57 | 83 |
| 89 | 282 | 700082237H1 | SATMON011 | g169820 | BLASTN | 793 | 1e−57 | 84 |
| 90 | 282 | 700261906H1 | SATMON017 | g169820 | BLASTN | 796 | 1e−57 | 83 |
| 91 | 282 | 700456154H1 | SATMON029 | g169820 | BLASTN | 799 | 1e−57 | 84 |
| 92 | 282 | 700047696H1 | SATMON003 | g169820 | BLASTN | 561 | 1e−56 | 83 |
| 93 | 282 | 700449905H1 | SATMON028 | g169820 | BLASTN | 788 | 1e−56 | 84 |
| 94 | 282 | 700336106H1 | SATMON019 | g217973 | BLASTN | 325 | 1e−55 | 92 |
| 95 | 282 | 700381867H1 | SATMON023 | g2529386 | BLASTN | 422 | 1e−55 | 97 |
| 96 | 282 | 700051335H1 | SATMON003 | g169820 | BLASTN | 608 | 1e−55 | 83 |
| 97 | 282 | 700050988H1 | SATMON003 | g169820 | BLASTN | 768 | 1e−55 | 86 |
| 98 | 282 | 700029471H1 | SATMON003 | g169820 | BLASTN | 772 | 1e−55 | 84 |
| 99 | 282 | 700106806H1 | SATMON010 | g169820 | BLASTN | 773 | 1e−55 | 84 |
| 100 | 282 | 700071749H1 | SATMON007 | g217973 | BLASTN | 362 | 1e−54 | 85 |
| 101 | 282 | 700207607H1 | SATMON016 | g217973 | BLASTN | 362 | 1e−54 | 85 |
| 102 | 282 | 700573465H2 | SATMON030 | g169820 | BLASTN | 753 | 1e−54 | 86 |
| 103 | 282 | 700220908H1 | SATMON011 | g169820 | BLASTN | 758 | 1e−54 | 84 |
| 104 | 282 | 700467719H1 | SATMON025 | g169820 | BLASTN | 761 | 1e−54 | 85 |
| 105 | 282 | 700456018H1 | SATMON029 | g169820 | BLASTN | 764 | 1e−54 | 81 |
| 106 | 282 | 700453767H1 | SATMON029 | g217973 | BLASTN | 296 | 1e−52 | 94 |
| 107 | 282 | 700026118H1 | SATMON003 | g217973 | BLASTN | 341 | 1e−52 | 93 |
| 108 | 282 | 700026760H1 | SATMON003 | g217973 | BLASTN | 421 | 1e−52 | 99 |
| 109 | 282 | 700029525H1 | SATMON003 | g169820 | BLASTN | 738 | 1e−52 | 85 |
| 110 | 282 | 700457972H1 | SATMON029 | g169820 | BLASTN | 723 | 1e−51 | 85 |
| 111 | 282 | 700455866H1 | SATMON029 | g169820 | BLASTN | 726 | 1e−51 | 84 |
| 112 | 282 | 700165290H1 | SATMON013 | g169820 | BLASTN | 726 | 1e−51 | 84 |
| 113 | 282 | 700351190H1 | SATMON023 | g169820 | BLASTN | 672 | 1e−50 | 81 |
| 114 | 282 | 700154095H1 | SATMON007 | g169820 | BLASTN | 696 | 1e−49 | 84 |
| 115 | 282 | 700450438H1 | SATMON028 | g217973 | BLASTN | 430 | 1e−48 | 99 |
| 116 | 282 | 700044892H1 | SATMON004 | g169820 | BLASTN | 683 | 1e−48 | 85 |
| 117 | 282 | 700185095H1 | SATMON014 | g169820 | BLASTN | 673 | 1e−47 | 84 |
| 118 | 282 | 700575506H1 | SATMON030 | g169820 | BLASTN | 680 | 1e−47 | 83 |
| 119 | 282 | 700161966H1 | SATMON012 | g217973 | BLASTN | 335 | 1e−46 | 98 |
| 120 | 282 | 700343401H1 | SATMON021 | g169820 | BLASTN | 426 | 1e−45 | 77 |
| 121 | 282 | 700152354H1 | SATMON007 | g169820 | BLASTN | 653 | 1e−45 | 84 |
| 122 | 282 | 701164924H1 | SATMONN04 | g169820 | BLASTN | 397 | 1e−44 | 84 |
| 123 | 282 | 700346896H1 | SATMON021 | g169820 | BLASTN | 496 | 1e−42 | 84 |
| 124 | 282 | 700210157H1 | SATMON016 | g169820 | BLASTN | 617 | 1e−42 | 84 |
| 125 | 282 | 700383103H1 | SATMON024 | g169820 | BLASTN | 531 | 1e−41 | 84 |
| 126 | 282 | 701158829H1 | SATMONN04 | g407524 | BLASTN | 549 | 1e−40 | 80 |
| 127 | 282 | 700619883H1 | SATMON034 | g217973 | BLASTN | 325 | 1e−38 | 99 |
| 128 | 282 | 700168219H1 | SATMON013 | g169820 | BLASTN | 540 | 1e−36 | 83 |
| 129 | 282 | 700155210H1 | SATMON007 | g169820 | BLASTN | 545 | 1e−36 | 83 |
| 130 | 282 | 700334861H1 | SATMON019 | g169820 | BLASTN | 484 | 1e−31 | 82 |
| 131 | 282 | 700355663H1 | SATMON024 | g217973 | BLASTN | 213 | 1e−30 | 88 |
| 132 | 282 | 700074764H1 | SATMON007 | g546734 | BLASTN | 387 | 1e−27 | 84 |
| 133 | 282 | 700621934H1 | SATMON034 | g217973 | BLASTN | 430 | 1e−26 | 100 |
| 134 | 282 | 700802084H1 | SATMON036 | g217973 | BLASTN | 270 | 1e−24 | 98 |
| 135 | 3039 | 700620444H1 | SATMON034 | g1785947 | BLASTN | 473 | 1e−56 | 75 |
| 136 | 3039 | 700356205H1 | SATMON024 | g1785947 | BLASTN | 332 | 1e−32 | 72 |
| 137 | 3039 | 700215549H1 | SATMON016 | g414549 | BLASTN | 443 | 1e−26 | 72 |
| 138 | 3039 | 700620318H1 | SATMON034 | g556171 | BLASTX | 214 | 1e−25 | 79 |
| 139 | 3039 | 700028742H1 | SATMON003 | g556171 | BLASTX | 156 | 1e−20 | 86 |
| 140 | 3039 | 700150060H1 | SATMON007 | g556171 | BLASTX | 181 | 1e−17 | 89 |
| 141 | 3039 | 700448477H1 | SATMON027 | g556171 | BLASTX | 137 | 1e−12 | 85 |
| 142 | 3039 | 700336489H1 | SATMON019 | g556171 | BLASTX | 126 | 1e−10 | 81 |
| 143 | 3414 | 700099709H1 | SATMON009 | g609261 | BLASTN | 600 | 1e−49 | 84 |
| 144 | 3414 | 700075837H1 | SATMON007 | g609261 | BLASTN | 494 | 1e−41 | 84 |
| 145 | 3414 | 700045678H1 | SATMON004 | g609261 | BLASTN | 340 | 1e−29 | 73 |
| 146 | 3414 | 700097852H1 | SATMON009 | g609261 | BLASTN | 436 | 1e−27 | 84 |
| 147 | 3414 | 700053342H1 | SATMON009 | g609261 | BLASTN | 346 | 1e−25 | 73 |
| 148 | 3414 | 700041954H1 | SATMON004 | g609261 | BLASTN | 340 | 1e−24 | 82 |
| 149 | 3414 | 700217471H1 | SATMON016 | g609261 | BLASTN | 265 | 1e−21 | 71 |
| 150 | 3414 | 700264437H1 | SATMON017 | g609261 | BLASTN | 231 | 1e−17 | 69 |

TABLE A*-continued

| Seq No. | Cluster ID | CloneID | Library | NCBI gi | Method | Score | P-value | % Ident |
|---|---|---|---|---|---|---|---|---|
| 151 | 3414 | 700218371H1 | SATMON016 | g609261 | BLASTN | 156 | 1e-10 | 68 |
| 152 | 5593 | 700381686H1 | SATMON023 | g609261 | BLASTN | 534 | 1e-44 | 89 |
| 153 | 5593 | 700356082H1 | SATMON024 | g609261 | BLASTN | 246 | 1e-24 | 90 |
| 154 | 5593 | 700622077H1 | SATMON034 | g609261 | BLASTN | 292 | 1e-20 | 86 |
| 155 | 5593 | 700470822H1 | SATMON025 | g609262 | BLASTX | 134 | 1e-11 | 79 |
| 156 | 6525 | 700083139H1 | SATMON011 | g256119 | BLASTN | 880 | 1e-64 | 76 |
| 157 | 6525 | 700205474H1 | SATMON003 | g169820 | BLASTN | 849 | 1e-62 | 77 |
| 158 | 6991 | 700336856H1 | SATMON019 | g609261 | BLASTN | 1131 | 1e-85 | 85 |
| 159 | 6991 | 700042717H1 | SATMON004 | g609261 | BLASTN | 1028 | 1e-76 | 85 |
| 160 | 6991 | 700379491H1 | SATMON020 | g609261 | BLASTN | 995 | 1e-74 | 81 |
| 161 | 6991 | 700156635H1 | SATMON012 | g609261 | BLASTN | 877 | 1e-64 | 84 |
| 162 | 6991 | 700046340H1 | SATMON004 | g609261 | BLASTN | 852 | 1e-62 | 84 |
| 163 | 6991 | 700081869H1 | SATMON011 | g609261 | BLASTN | 266 | 1e-14 | 80 |
| 164 | 6991 | 700426102H1 | SATMONN01 | g806312 | BLASTX | 134 | 1e-13 | 89 |
| 165 | 7384 | 700613626H1 | SATMON033 | g609261 | BLASTN | 920 | 1e-87 | 85 |
| 166 | 7384 | 700101506H1 | SATMON009 | g609261 | BLASTN | 1124 | 1e-84 | 85 |
| 167 | 7384 | 700206445H1 | SATMON003 | g609261 | BLASTN | 987 | 1e-73 | 79 |
| 168 | 7384 | 700220160H1 | SATMON011 | g609261 | BLASTN | 878 | 1e-64 | 85 |
| 169 | −L1431527 | LIB143-004-Q1-E1-C5 | LIB143 | g217973 | BLASTN | 290 | 1e-13 | 93 |
| 170 | −L30613868 | LIB3061-017-Q1-K1-C9 | LIB3061 | g217973 | BLASTN | 182 | 1e-13 | 70 |
| 171 | −L30623620 | LIB3062-034-Q1-K1-A8 | LIB3062 | g609261 | BLASTN | 599 | 1e-39 | 74 |
| 172 | −L361705 | LIB36-021-Q1-E1-E7 | LIB36 | g609261 | BLASTN | 266 | 1e-14 | 80 |
| 173 | 23992 | LIB3062-056-Q1-K1-F9 | LIB3062 | g1200507 | BLASTX | 285 | 1e-64 | 61 |
| 174 | 282 | LIB3067-047-Q1-K1-H2 | LIB3067 | g217973 | BLASTN | 1076 | 1e-164 | 96 |
| 175 | 282 | LIB3067-055-Q1-K1-G8 | LIB3067 | g217973 | BLASTN | 1076 | 1e-133 | 93 |
| 176 | 282 | LIB3067-059-Q1-K1-D10 | LIB3067 | g169820 | BLASTN | 1401 | 1e-115 | 84 |
| 177 | 282 | LIB3067-027-Q1-K1-B10 | LIB3067 | g407524 | BLASTN | 995 | 1e-113 | 83 |
| 178 | 282 | LIB189-032-Q1-E1-H2 | LIB189 | g217973 | BLASTN | 629 | 1e-111 | 93 |
| 179 | 282 | LIB3059-023-Q1-K1-A7 | LIB3059 | g407524 | BLASTN | 1436 | 1e-111 | 83 |
| 180 | 282 | LIB3069-016-Q1-K1-D9 | LIB3069 | g169820 | BLASTN | 1301 | 1e-107 | 81 |
| 181 | 282 | LIB143-006-Q1-E1-A8 | LIB143 | g169820 | BLASTN | 1373 | 1e-105 | 84 |
| 182 | 282 | LIB3068-054-Q1-K1-C11 | LIB3068 | g169820 | BLASTN | 1327 | 1e-102 | 82 |
| 183 | 282 | LIB3067-034-Q1-K1-B7 | LIB3067 | g407524 | BLASTN | 1321 | 1e-101 | 83 |
| 184 | 282 | LIB143-031-Q1-E1-E5 | LIB143 | g169820 | BLASTN | 1311 | 1e-100 | 84 |
| 185 | 282 | LIB3069-055-Q1-K1-H12 | LIB3069 | g169820 | BLASTN | 1046 | 1e-97 | 75 |
| 186 | 282 | LIB3061-027-Q1-K1-A8 | LIB3061 | g169820 | BLASTN | 936 | 1e-96 | 83 |
| 187 | 282 | LIB3078-008-Q1-K1-E5 | LIB3078 | g169820 | BLASTN | 1210 | 1e-92 | 82 |
| 188 | 282 | LIB3066-027-Q1-K1-E1 | LIB3066 | g407524 | BLASTN | 1196 | 1e-91 | 82 |
| 189 | 282 | LIB3067-032-Q1-K1-E5 | LIB3067 | g169820 | BLASTN | 1122 | 1e-84 | 84 |
| 190 | 282 | LIB3078-029-Q1-K1-F7 | LIB3078 | g169820 | BLASTN | 827 | 1e-83 | 82 |
| 191 | 282 | LIB3061-006-Q1-K1-B7 | LIB3061 | g169820 | BLASTN | 1091 | 1e-82 | 78 |
| 192 | 282 | LIB143-048-Q1-E1-F8 | LIB143 | g169820 | BLASTN | 644 | 1e-74 | 75 |
| 193 | 282 | LIB3078-033-Q1-K1-B10 | LIB3078 | g169820 | BLASTN | 584 | 1e-73 | 79 |
| 194 | 282 | LIB3069-046-Q1-K1-C4 | LIB3069 | g169820 | BLASTN | 819 | 1e-59 | 79 |
| 195 | 282 | LIB3061-049-Q1-K1-H2 | LIB3061 | g169820 | BLASTN | 587 | 1e-47 | 80 |
| 196 | 282 | LIB143-029-Q1-E1-G4 | LIB143 | g169820 | BLASTN | 679 | 1e-47 | 84 |
| 197 | 282 | LIB84-027-Q1-E1-E5 | LIB84 | g169820 | BLASTN | 613 | 1e-46 | 78 |

TABLE A*-continued

| Seq No. | Cluster ID | CloneID | Library | NCBI gi | Method | Score | P-value | % Ident |
|---|---|---|---|---|---|---|---|---|
| 198 | 282 | LIB3062-00l-Q1-K2-F7 | LIB3062 | g169820 | BLASTN | 507 | 1e−33 | 80 |
| 199 | 282 | LIB3066-014-Q1-K1-H11 | LIB3066 | g169820 | BLASTN | 385 | 1e−25 | 76 |
| 200 | 29645 | LIB3069-014-Q1-K1-C11 | LIB3069 | g168647 | BLASTX | 131 | 1e−27 | 34 |
| 201 | 29645 | LIB3069-013-Q1-K1-C11 | LIB3069 | g168647 | BLASTX | 124 | 1e−24 | 33 |
| 202 | 3039 | LIB3062-045-Q1-K1-F6 | LIB3062 | g1785947 | BLASTN | 1119 | 1e−84 | 72 |
| 203 | 5593 | LIB3067-045-Q1-K1-E5 | LIB3067 | g609261 | BLASTN | 702 | 1e−58 | 75 |
| 204 | 6991 | LIB3059-026-Q1-K1-G9 | LIB3059 | g609261 | BLASTN | 1493 | 1e−115 | 84 |
| 205 | 6991 | LIB3078-049-Q1-K1-E4 | LIB3078 | g609261 | BLASTN | 747 | 1e−55 | 83 |
| 206 | 7384 | LIB3062-034-Q1-K1-A4 | LIB3062 | g609261 | BLASTN | 1351 | 1e−107 | 85 |
| MAIZE FRUCTOSE 1,6-BISPHOSPHATE ALDOLASE | | | | | | | | |
| 207 | −700026544 | 700026544H1 | SATMON003 | g22144 | BLASTN | 215 | 1e−30 | 88 |
| 208 | −700073329 | 700073329H1 | SATMON007 | g22144 | BLASTN | 590 | 1e−89 | 95 |
| 209 | −700151987 | 700151987H1 | SATMON007 | g22144 | BLASTN | 212 | 1e−8 | 78 |
| 210 | −700206575 | 700206575H1 | SATMON003 | g22144 | BLASTN | 1009 | 1e−109 | 96 |
| 211 | −700333727 | 700333727H1 | SATMON019 | g1217893 | BLASTX | 154 | 1e−16 | 61 |
| 212 | −700429795 | 700429795H1 | SATMONN01 | g1619605 | BLASTX | 102 | 1e−16 | 77 |
| 213 | −700804137 | 700804137H1 | SATMON036 | g22144 | BLASTN | 742 | 1e−52 | 92 |
| 214 | 1182 | 700449930H1 | SATMON028 | g22632 | BLASTN | 856 | 1e−62 | 79 |
| 215 | 1182 | 701185559H1 | SATMONN06 | g22632 | BLASTN | 793 | 1e−57 | 79 |
| 216 | 1182 | 700203130H1 | SATMON003 | g22632 | BLASTN | 799 | 1e−57 | 78 |
| 217 | 1182 | 700083459H1 | SATMON011 | g22632 | BLASTN | 800 | 1e−57 | 76 |
| 218 | 1182 | 700465449H1 | SATMON025 | g22632 | BLASTN | 405 | 1e−50 | 76 |
| 219 | 1182 | 701165344H1 | SATMONN04 | g22632 | BLASTN | 326 | 1e−29 | 78 |
| 220 | 1182 | 700427538H1 | SATMONN01 | g438275 | BLASTX | 96 | 1e−9 | 88 |
| 221 | 38 | 700224356H1 | SATMON011 | g22144 | BLASTN | 1290 | 1e−98 | 96 |
| 222 | 38 | 700048169H1 | SATMON003 | g22144 | BLASTN | 528 | 1e−72 | 98 |
| 223 | 38 | 700616610H1 | SATMON033 | g22144 | BLASTN | 278 | 1e−31 | 91 |
| 224 | 38 | 700355765H1 | SATMON024 | g20204 | BLASTX | 141 | 1e−12 | 96 |
| 225 | 6547 | 700194431H1 | SATMON014 | g2636513 | BLASTX | 181 | 1e−17 | 47 |
| 226 | 6547 | 700469777H1 | SATMON025 | g2636513 | BLASTX | 174 | 1e−16 | 48 |
| 227 | 8494 | 700425929H1 | SATMONN01 | g927507 | BLASTX | 67 | 1e−11 | 89 |
| 228 | −L30603643 | LIB3060-046-Q1-K1-G7 | LIB3060 | g169037 | BLASTX | 155 | 1e−44 | 66 |
| 229 | 1182 | LIB3079-006-Q1-K1-H8 | LIB3079 | g22632 | BLASTN | 598 | 1e−39 | 65 |
| 230 | 28633 | LIB3062-015-Q1-K1-G12 | LIB3062 | g1208898 | BLASTX | 116 | 1e−24 | 45 |
| 231 | 38 | LIB3061-025-Q1-K1-C9 | LIB3061 | g22144 | BLASTN | 895 | 1e−133 | 94 |
| 232 | 38 | LIB3059-020-Q1-K1-H3 | LIB3059 | g22144 | BLASTN | 745 | 1e−53 | 98 |
| MAIZE FRUCTOSE-1,6-BISPHOSPHATASE | | | | | | | | |
| 233 | −700262935 | 700262935H1 | SATMON017 | g3041775 | BLASTX | 184 | 1e−18 | 94 |
| 234 | −700432173 | 700432173H1 | SATMONN01 | g1790679 | BLASTX | 123 | 1e−16 | 56 |
| 235 | −700455709 | 700455709H1 | SATMON029 | g3041776 | BLASTX | 597 | 1e−40 | 85 |
| 236 | −700573083 | 700573083H1 | SATMON030 | g3041775 | BLASTX | 69 | 1e−10 | 64 |
| 237 | 12846 | 700101851H1 | SATMON009 | g3041776 | BLASTN | 1312 | 1e−100 | 91 |
| 238 | 12846 | 700101541H1 | SATMON009 | g3041776 | BLASTN | 1252 | 1e−95 | 90 |
| 239 | 12846 | 700581510H1 | SATMON031 | g3041776 | BLASTN | 872 | 1e−82 | 90 |
| 240 | 15627 | 700046054H1 | SATMON004 | g21736 | BLASTN | 1213 | 1e−92 | 91 |
| 241 | 15627 | 700421605H1 | SATMONN01 | g3041776 | BLASTN | 664 | 1e−77 | 90 |
| 242 | 15627 | 700445495H1 | SATMON027 | g21736 | BLASTN | 1004 | 1e−74 | 84 |
| 243 | 15627 | 700042188H1 | SATMON004 | g3041776 | BLASTN | 875 | 1e−64 | 88 |
| 244 | 16870 | 700100752H1 | SATMON009 | g3041776 | BLASTN | 257 | 1e−33 | 75 |
| 245 | 16870 | 700048805H1 | SATMON004 | g3041776 | BLASTN | 194 | 1e−14 | 76 |
| 246 | 16870 | 700099217H1 | SATMON009 | g21736 | BLASTN | 246 | 1e−9 | 59 |
| 247 | 5480 | 700442189H1 | SATMON026 | g3041774 | BLASTN | 536 | 1e−54 | 93 |
| 248 | 8243 | 700264654H1 | SATMON017 | g3041774 | BLASTN | 942 | 1e−69 | 84 |
| 249 | 8243 | 700479624H1 | SATMON034 | g3041774 | BLASTN | 902 | 1e−66 | 82 |
| 250 | 8243 | 700448974H1 | SATMON028 | g3041774 | BLASTN | 876 | 1e−64 | 84 |
| 251 | −L1485381 | LIB148-057-Q1-E1-E6 | LIB148 | g440591 | BLASTX | 80 | 1e−30 | 63 |
| 252 | −L30662839 | LIB3066-035-Q1-K1-F11 | LIB3066 | g3041774 | BLASTN | 215 | 1e−15 | 77 |
| 253 | −L362913 | LIB36-013-Q1-E1-D10 | LIB36 | g3041776 | BLASTN | 937 | 1e−69 | 88 |

TABLE A*-continued

| Seq No. | Cluster ID | CloneID | Library | NCBI gi | Method | Score | P-value | % Ident |
|---|---|---|---|---|---|---|---|---|
| 254 | −L832444 | LIB83-005-Q1-E1-D2 | LIB83 | g3041776 | BLASTN | 575 | 1e−37 | 93 |
| 255 | 12846 | LIB83-008-Q1-E1-A8 | LIB83 | g3041776 | BLASTN | 1610 | 1e−135 | 92 |
| 256 | 12846 | LIB3078-003-Q1-K1-C7 | LIB3078 | g3041776 | BLASTN | 873 | 1e−98 | 93 |
| 257 | 16870 | LIB3060-052-Q1-K1-D11 | LIB3060 | g21736 | BLASTN | 377 | 1e−66 | 70 |
| 258 | 26002 | LIB83-008-Q1-E1-B10 | LIB83 | g3041776 | BLASTN | 378 | 1e−20 | 86 |
| MAIZE FRUCTOSE-6-PHOSPHATE,2-KINASE | | | | | | | | |
| 259 | −700093724 | 700093724H1 | SATMON008 | g3170230 | BLASTX | 123 | 1e−21 | 53 |
| 260 | −700099547 | 700099547H1 | SATMON009 | g3309582 | BLASTN | 630 | 1e−43 | 80 |
| 261 | −700100682 | 700100682H1 | SATMON009 | g3170230 | BLASTX | 269 | 1e−39 | 65 |
| 262 | −700173085 | 700173085H1 | SATMON013 | g2286154 | BLASTN | 1165 | 1e−88 | 100 |
| 263 | −700217623 | 700217623H1 | SATMON016 | g3170229 | BLASTN | 593 | 1e−40 | 73 |
| 264 | −700219340 | 700219340H1 | SATMON011 | g3170230 | BLASTX | 190 | 1e−20 | 56 |
| 265 | −700265353 | 700265353H1 | SATMON017 | g2286154 | BLASTN | 1268 | 1e−107 | 98 |
| 266 | −700379777 | 700379777H1 | SATMON021 | g3309582 | BLASTN | 905 | 1e−66 | 76 |
| 267 | −700620963 | 700620963H1 | SATMON034 | g2286154 | BLASTN | 376 | 1e−52 | 85 |
| 268 | −701159590 | 701159590H1 | SATMONN04 | g3309582 | BLASTN | 682 | 1e−48 | 73 |
| 269 | 20094 | 700209789H1 | SATMON016 | g2286154 | BLASTN | 1093 | 1e−96 | 92 |
| 270 | 20094 | 700550375H1 | SATMON022 | g3309582 | BLASTN | 780 | 1e−58 | 81 |
| 271 | 29193 | 700021150H1 | SATMON001 | g2286154 | BLASTN | 466 | 1e−75 | 92 |
| 272 | −L30593297 | LIB3059-029-Q1-K1-B3 | LIB3059 | g2286154 | BLASTN | 401 | 1e−22 | 70 |
| 273 | −L30614892 | LIB3061-021-Q1-K1-G9 | LIB3061 | g2286154 | BLASTN | 469 | 1e−38 | 79 |
| 274 | −L30623700 | LIB3062-031-Q1-K1-E8 | LIB3062 | g3170229 | BLASTN | 230 | 1e−10 | 70 |
| 275 | 29193 | LIB83-007-Q1-E1-C11 | LIB83 | g2286154 | BLASTN | 595 | 1e−113 | 90 |
| MAIZE PHOSPHOGLUCOISOMERASE | | | | | | | | |
| 276 | −700086021 | 700086021H1 | SATMON011 | g1100771 | BLASTX | 225 | 1e−28 | 51 |
| 277 | −700169489 | 700169489H1 | SATMON013 | g1100771 | BLASTX | 152 | 1e−13 | 59 |
| 278 | −700222638 | 700222638H1 | SATMON011 | g1100771 | BLASTX | 256 | 1e−28 | 60 |
| 279 | −700445574 | 700445574H1 | SATMON027 | g1100771 | BLASTX | 143 | 1e−12 | 54 |
| 280 | −700475232 | 700475232H1 | SATMON025 | g596022 | BLASTN | 845 | 1e−61 | 90 |
| 281 | −700612774 | 700612774H1 | SATMON033 | g596022 | BLASTN | 1574 | 1e−122 | 95 |
| 282 | 14393 | 700222547H1 | SATMON011 | g1100771 | BLASTX | 239 | 1e−25 | 60 |
| 283 | 14393 | 700220357H1 | SATMON011 | g1100771 | BLASTX | 218 | 1e−23 | 68 |
| 284 | 14393 | 700050317H1 | SATMON003 | g1100771 | BLASTX | 120 | 1e−22 | 63 |
| 285 | 14393 | 700163544H1 | SATMON013 | g1100771 | BLASTX | 214 | 1e−22 | 62 |
| 286 | 15724 | 700207164H1 | SATMON017 | g1100771 | BLASTX | 135 | 1e−17 | 67 |
| 287 | 15724 | 700552402H1 | SATMON022 | g1100771 | BLASTX | 135 | 1e−11 | 60 |
| 288 | 15724 | 700086085H1 | SATMON011 | g1100771 | BLASTX | 137 | 1e−11 | 45 |
| 289 | 20643 | 700577051H1 | SATMON031 | g1100771 | BLASTX | 241 | 1e−26 | 66 |
| 290 | 20643 | 700201592H1 | SATMON003 | g1100771 | BLASTX | 113 | 1e−19 | 45 |
| 291 | 20643 | 700576644H1 | SATMON030 | g1100771 | BLASTX | 113 | 1e−17 | 43 |
| 292 | 2351 | 700208928H1 | SATMON016 | g1100771 | BLASTX | 274 | 1e−43 | 73 |
| 293 | 2351 | 700240758H1 | SATMON010 | g1100771 | BLASTX | 283 | 1e−43 | 79 |
| 294 | 2351 | 700352502H1 | SATMON023 | g1100771 | BLASTX | 197 | 1e−36 | 70 |
| 295 | 2351 | 700581930H1 | SATMON031 | g1100771 | BLASTX | 164 | 1e−34 | 72 |
| 296 | 2351 | 700028642H1 | SATMON003 | g1100771 | BLASTX | 294 | 1e−33 | 65 |
| 297 | 2351 | 700106092H1 | SATMON010 | g1100771 | BLASTX | 294 | 1e−33 | 62 |
| 298 | 2351 | 700082102H1 | SATMON011 | g1100771 | BLASTX | 300 | 1e−33 | 62 |
| 299 | 2351 | 700083446H1 | SATMON011 | g1100771 | BLASTX | 274 | 1e−30 | 65 |
| 300 | 2351 | 700580585H1 | SATMON031 | g1100771 | BLASTX | 163 | 1e−29 | 69 |
| 301 | 2351 | 700550608H1 | SATMON022 | g1100771 | BLASTX | 265 | 1e−29 | 61 |
| 302 | 2351 | 700106079H1 | SATMON010 | g1100771 | BLASTX | 261 | 1e−28 | 54 |
| 303 | 2351 | 700244248H1 | SATMON010 | g1100771 | BLASTX | 238 | 1e−25 | 67 |
| 304 | 2351 | 700152233H1 | SATMON007 | g1100771 | BLASTX | 167 | 1e−22 | 72 |
| 305 | 2351 | 700455043H1 | SATMON029 | g1100771 | BLASTX | 168 | 1e−21 | 68 |
| 306 | 2351 | 700615809H1 | SATMON033 | g1100771 | BLASTX | 207 | 1e−21 | 66 |
| 307 | 2351 | 701165320H1 | SATMONN04 | g1100771 | BLASTX | 122 | 1e−14 | 63 |
| 308 | 32930 | 700042996H1 | SATMON004 | g596022 | BLASTN | 476 | 1e−95 | 98 |
| 309 | 4222 | 700222539H1 | SATMON011 | g596022 | BLASTN | 1160 | 1e−87 | 100 |
| 310 | 4222 | 700104023H1 | SATMON010 | g596022 | BLASTN | 1060 | 1e−84 | 100 |
| 311 | 4222 | 700101580H1 | SATMON009 | g596022 | BLASTN | 871 | 1e−74 | 99 |
| 312 | 4222 | 700473395H1 | SATMON025 | g596022 | BLASTN | 368 | 1e−46 | 95 |
| 313 | 4222 | 700800179H1 | SATMON036 | g596022 | BLASTN | 240 | 1e−11 | 100 |
| 314 | 8858 | 700221523H1 | SATMON011 | g1100771 | BLASTX | 278 | 1e−31 | 59 |
| 315 | 895 | 700100965H1 | SATMON009 | g596022 | BLASTN | 1611 | 1e−125 | 99 |
| 316 | 895 | 700620985H1 | SATMON034 | g596022 | BLASTN | 1418 | 1e−114 | 98 |
| 317 | 895 | 700082062H1 | SATMON011 | g596022 | BLASTN | 1365 | 1e−110 | 97 |

TABLE A*-continued

| Seq No. | Cluster ID | CloneID | Library | NCBI gi | Method | Score | P-value | % Ident |
|---|---|---|---|---|---|---|---|---|
| 318 | 895 | 700573782H1 | SATMON030 | g596022 | BLASTN | 920 | 1e−107 | 98 |
| 319 | 895 | 700236138H1 | SATMON010 | g596022 | BLASTN | 1395 | 1e−107 | 100 |
| 320 | 895 | 700086336H1 | SATMON011 | g596022 | BLASTN | 1370 | 1e−105 | 100 |
| 321 | 895 | 700801467H1 | SATMON036 | g596022 | BLASTN | 1249 | 1e−99 | 95 |
| 322 | 895 | 700801458H1 | SATMON036 | g596022 | BLASTN | 1245 | 1e−98 | 100 |
| 323 | 895 | 700475024H1 | SATMON025 | g596022 | BLASTN | 1162 | 1e−97 | 93 |
| 324 | 895 | 700243164H1 | SATMON010 | g596022 | BLASTN | 1105 | 1e−96 | 100 |
| 325 | 895 | 700804665H1 | SATMON036 | g596022 | BLASTN | 1266 | 1e−96 | 99 |
| 326 | 895 | 700021931H1 | SATMON001 | g596022 | BLASTN | 1126 | 1e−84 | 99 |
| 327 | 895 | 700805540H1 | SATMON036 | g596022 | BLASTN | 776 | 1e−55 | 99 |
| 328 | 895 | 700172576H1 | SATMON013 | g596022 | BLASTN | 571 | 1e−38 | 98 |
| 329 | 895 | 700105116H1 | SATMON010 | g596022 | BLASTN | 558 | 1e−37 | 99 |
| 330 | 895 | 700472931H1 | SATMON025 | g596022 | BLASTN | 379 | 1e−31 | 97 |
| 331 | 20643 | LIB3069-009-Q1-K1-B3 | LIB3069 | g1100771 | BLASTX | 215 | 1e−44 | 50 |
| 332 | 2351 | LIB3079-007-Q1-K1-C11 | LIB3079 | g1100771 | BLASTX | 304 | 1e−77 | 72 |
| 333 | 32930 | LIB189-001-Q1-E1-E4 | LIB189 | g596022 | BLASTN | 794 | 1e−115 | 95 |
| 334 | 4222 | LIB3079-001-Q1-K1-H7 | LIB3079 | g596022 | BLASTN | 1132 | 1e−101 | 89 |
| 335 | 895 | LIB148-049-Q1-E1-D6 | LIB148 | g596022 | BLASTN | 2194 | 1e−178 | 97 |
| 336 | 895 | LIB3066-052-Q1-K1-G8 | LIB3066 | g596022 | BLASTN | 2178 | 1e−172 | 97 |
| 337 | 895 | LIB148-016-Q1-E1-G5 | LIB148 | g596022 | BLASTN | 1567 | 1e−161 | 99 |
| 338 | 895 | LIB143-032-Q1-E1-E10 | LIB143 | g596022 | BLASTN | 1914 | 1e−155 | 99 |
| 339 | 895 | LIB3061-013-Q1-K1-F7 | LIB3061 | g596022 | BLASTN | 1738 | 1e−136 | 88 |
| 340 | 895 | LIB143-047-Q1-E1-D4 | LIB143 | g596022 | BLASTN | 1490 | 1e−119 | 88 |
| MAIZE VACUOLAR H+-TRANSLOCATING-PYROPHOSPHATASE | | | | | | | | |
| 341 | −700163331 | 700163331H1 | SATMON013 | g534915 | BLASTN | 751 | 1e−53 | 77 |
| 342 | −700171438 | 700171438H1 | SATMON013 | g2258073 | BLASTN | 256 | 1e−10 | 76 |
| 343 | −700202576 | 700202576H1 | SATMON003 | g2668746 | BLASTX | 214 | 1e−23 | 84 |
| 344 | −700206487 | 700206487H1 | SATMON003 | g2570501 | BLASTN | 174 | 1e−17 | 86 |
| 345 | −700217292 | 700217292H1 | SATMON016 | g2668746 | BLASTX | 214 | 1e−23 | 100 |
| 346 | −700240889 | 700240889H1 | SATMON010 | g2570500 | BLASTN | 639 | 1e−47 | 84 |
| 347 | −700347658 | 700347658H1 | SATMON023 | g2668746 | BLASTX | 215 | 1e−23 | 95 |
| 348 | −700454151 | 700454151H1 | SATMON029 | g2668745 | BLASTN | 172 | 1e−10 | 90 |
| 349 | −700454532 | 700454532H1 | SATMON029 | g2668745 | BLASTN | 259 | 1e−38 | 93 |
| 350 | −700552133 | 700552133H1 | SATMON022 | g457744 | BLASTX | 176 | 1e−19 | 68 |
| 351 | −700611864 | 700611864H1 | SATMON022 | g2668745 | BLASTN | 203 | 1e−9 | 84 |
| 352 | 107 | 700622451H1 | SATMON034 | g2668745 | BLASTN | 1645 | 1e−129 | 100 |
| 353 | 107 | 700571235H1 | SATMON030 | g2668745 | BLASTN | 1406 | 1e−125 | 98 |
| 354 | 107 | 700266126H1 | SATMON017 | g2668745 | BLASTN | 1145 | 1e−121 | 100 |
| 355 | 107 | 700621607H1 | SATMON034 | g2668745 | BLASTN | 1375 | 1e−121 | 99 |
| 356 | 107 | 700345080H1 | SATMON021 | g2668745 | BLASTN | 1195 | 1e−117 | 100 |
| 357 | 107 | 700624257H1 | SATMON034 | g2668745 | BLASTN | 825 | 1e−115 | 100 |
| 358 | 107 | 700030359H1 | SATMON003 | g2668745 | BLASTN | 1470 | 1e−114 | 100 |
| 359 | 107 | 700214462H1 | SATMON016 | g2668745 | BLASTN | 1223 | 1e−110 | 98 |
| 360 | 107 | 700356050H1 | SATMON024 | g2668745 | BLASTN | 1430 | 1e−110 | 100 |
| 361 | 107 | 701181128H1 | SATMONN06 | g2668745 | BLASTN | 1368 | 1e−105 | 98 |
| 362 | 107 | 700349795H1 | SATMON023 | g2668745 | BLASTN | 1370 | 1e−105 | 95 |
| 363 | 107 | 700473278H1 | SATMON025 | g2668745 | BLASTN | 1355 | 1e−104 | 100 |
| 364 | 107 | 700157057H1 | SATMON012 | g2668745 | BLASTN | 1345 | 1e−103 | 100 |
| 365 | 107 | 700622505H1 | SATMON034 | g2668745 | BLASTN | 762 | 1e−100 | 96 |
| 366 | 107 | 700219661H1 | SATMON011 | g2668745 | BLASTN | 942 | 1e−98 | 99 |
| 367 | 107 | 700619032H1 | SATMON034 | g2668745 | BLASTN | 989 | 1e−98 | 96 |
| 368 | 107 | 700620065H1 | SATMON034 | g2668745 | BLASTN | 1069 | 1e−98 | 94 |
| 369 | 107 | 700569179H1 | SATMON030 | g2668745 | BLASTN | 1233 | 1e−97 | 98 |
| 370 | 107 | 700156773H1 | SATMON012 | g2668745 | BLASTN | 1276 | 1e−97 | 99 |
| 371 | 107 | 700207120H1 | SATMON017 | g2668745 | BLASTN | 740 | 1e−96 | 99 |
| 372 | 107 | 700030407H1 | SATMON003 | g2668745 | BLASTN | 480 | 1e−95 | 98 |
| 373 | 107 | 700457309H1 | SATMON029 | g2668745 | BLASTN | 979 | 1e−95 | 99 |
| 374 | 107 | 700195681H1 | SATMON014 | g2668745 | BLASTN | 1246 | 1e−95 | 99 |
| 375 | 107 | 700444838H1 | SATMON027 | g2668745 | BLASTN | 1249 | 1e−95 | 96 |
| 376 | 107 | 700581619H1 | SATMON031 | g2668745 | BLASTN | 943 | 1e−94 | 96 |
| 377 | 107 | 700351021H1 | SATMON023 | g2668745 | BLASTN | 853 | 1e−91 | 92 |
| 378 | 107 | 700205723H1 | SATMON003 | g2668745 | BLASTN | 1138 | 1e−91 | 95 |
| 379 | 107 | 700159712H1 | SATMON012 | g2668745 | BLASTN | 1199 | 1e−91 | 94 |
| 380 | 107 | 700158937H1 | SATMON012 | g2668745 | BLASTN | 1132 | 1e−90 | 96 |
| 381 | 107 | 700336255H1 | SATMON019 | g2668745 | BLASTN | 489 | 1e−85 | 94 |
| 382 | 107 | 700422922H1 | SATMONN01 | g2668745 | BLASTN | 642 | 1e−84 | 95 |

TABLE A*-continued

| Seq No. | Cluster ID | CloneID | Library | NCBI gi | Method | Score | P-value | % Ident |
|---|---|---|---|---|---|---|---|---|
| 383 | 107 | 700347429H1 | SATMON023 | g2668745 | BLASTN | 891 | 1e−83 | 92 |
| 384 | 107 | 700350695H1 | SATMON023 | g2668745 | BLASTN | 960 | 1e−83 | 91 |
| 385 | 107 | 700212988H1 | SATMON016 | g2668745 | BLASTN | 988 | 1e−82 | 96 |
| 386 | 107 | 700345278H1 | SATMON021 | g2668745 | BLASTN | 989 | 1e−82 | 95 |
| 387 | 107 | 700264475H1 | SATMON017 | g2668745 | BLASTN | 1089 | 1e−82 | 99 |
| 388 | 107 | 700211923H1 | SATMON016 | g2668745 | BLASTN | 991 | 1e−81 | 94 |
| 389 | 107 | 700620974H1 | SATMON034 | g2668745 | BLASTN | 907 | 1e−80 | 92 |
| 390 | 107 | 700156401H1 | SATMON012 | g2668745 | BLASTN | 1058 | 1e−79 | 90 |
| 391 | 107 | 700172547H1 | SATMON013 | g2668745 | BLASTN | 1042 | 1e−78 | 96 |
| 392 | 107 | 700552384H1 | SATMON022 | g2668745 | BLASTN | 916 | 1e−76 | 96 |
| 393 | 107 | 700219926H1 | SATMON011 | g2668745 | BLASTN | 1005 | 1e−75 | 100 |
| 394 | 107 | 700357492H1 | SATMON024 | g2668745 | BLASTN | 610 | 1e−74 | 99 |
| 395 | 107 | 700343365H1 | SATMON021 | g2668745 | BLASTN | 891 | 1e−74 | 94 |
| 396 | 107 | 700018618H1 | SATMON001 | g2668745 | BLASTN | 1001 | 1e−74 | 93 |
| 397 | 107 | 700570755H1 | SATMON030 | g2668745 | BLASTN | 845 | 1e−71 | 93 |
| 398 | 107 | 700194777H1 | SATMON014 | g2668745 | BLASTN | 940 | 1e−69 | 100 |
| 399 | 107 | 700453790H1 | SATMON029 | g2668745 | BLASTN | 925 | 1e−68 | 92 |
| 400 | 107 | 700197306H1 | SATMON014 | g2668745 | BLASTN | 928 | 1e−68 | 85 |
| 401 | 107 | 700355750H1 | SATMON024 | g2668745 | BLASTN | 393 | 1e−66 | 93 |
| 402 | 107 | 700172940H1 | SATMON013 | g2668745 | BLASTN | 902 | 1e−66 | 97 |
| 403 | 107 | 700102133H1 | SATMON010 | g2668745 | BLASTN | 850 | 1e−62 | 100 |
| 404 | 107 | 700350332H1 | SATMON023 | g2668745 | BLASTN | 539 | 1e−57 | 97 |
| 405 | 107 | 700450285H1 | SATMON028 | g2668745 | BLASTN | 750 | 1e−53 | 100 |
| 406 | 107 | 700165003H1 | SATMON013 | g2668745 | BLASTN | 548 | 1e−52 | 83 |
| 407 | 107 | 700016136H1 | SATMON001 | g2668745 | BLASTN | 527 | 1e−50 | 85 |
| 408 | 107 | 700171557H1 | SATMON013 | g2668745 | BLASTN | 714 | 1e−50 | 95 |
| 409 | 107 | 700238156H1 | SATMON010 | g2668745 | BLASTN | 715 | 1e−50 | 96 |
| 410 | 107 | 700425175H1 | SATMONN01 | g2668745 | BLASTN | 698 | 1e−49 | 94 |
| 411 | 107 | 700354402H1 | SATMON024 | g2668745 | BLASTN | 616 | 1e−48 | 91 |
| 412 | 107 | 700159204H1 | SATMON012 | g2668745 | BLASTN | 617 | 1e−42 | 94 |
| 413 | 107 | 700623602H1 | SATMON034 | g2668745 | BLASTN | 460 | 1e−38 | 100 |
| 414 | 107 | 700612844H1 | SATMON033 | g2668745 | BLASTN | 421 | 1e−36 | 84 |
| 415 | 107 | 700621062H2 | SATMON034 | g2668745 | BLASTN | 285 | 1e−25 | 89 |
| 416 | 107 | 700335685H1 | SATMON019 | g2668745 | BLASTN | 339 | 1e−25 | 91 |
| 417 | 13843 | 700334949H1 | SATMON019 | g2570500 | BLASTN | 680 | 1e−55 | 83 |
| 418 | 13843 | 700346817H1 | SATMON021 | g2570500 | BLASTN | 705 | 1e−54 | 83 |
| 419 | 13843 | 700103380H1 | SATMON010 | g2570500 | BLASTN | 710 | 1e−54 | 83 |
| 420 | 13843 | 700348280H1 | SATMON023 | g2570500 | BLASTN | 669 | 1e−51 | 83 |
| 421 | 13843 | 700453203H1 | SATMON028 | g2570500 | BLASTN | 659 | 1e−50 | 82 |
| 422 | 13843 | 700381101H1 | SATMON023 | g2570500 | BLASTN | 621 | 1e−47 | 82 |
| 423 | 13843 | 700347617H1 | SATMON023 | g2570500 | BLASTN | 592 | 1e−44 | 85 |
| 424 | 13843 | 700043259H1 | SATMON004 | g2570500 | BLASTN | 530 | 1e−39 | 84 |
| 425 | 13843 | 701184447H1 | SATMONN06 | g2570500 | BLASTN | 481 | 1e−35 | 78 |
| 426 | 21076 | 700241354H1 | SATMON010 | g166634 | BLASTX | 201 | 1e−20 | 58 |
| 427 | 24066 | 700423113H1 | SATMONN01 | g457744 | BLASTX | 124 | 1e−23 | 54 |
| 428 | 24266 | 700577157H1 | SATMON031 | g2570500 | BLASTN | 1001 | 1e−74 | 89 |
| 429 | 2531 | 700099364H1 | SATMON009 | g2570500 | BLASTN | 669 | 1e−51 | 86 |
| 430 | 2531 | 700336387H1 | SATMON019 | g2570500 | BLASTN | 389 | 1e−47 | 85 |
| 431 | 2531 | 700217095H1 | SATMON016 | g2570500 | BLASTN | 451 | 1e−33 | 86 |
| 432 | 2531 | 700155869H1 | SATMON007 | g2570500 | BLASTN | 385 | 1e−27 | 89 |
| 433 | 2531 | 700575534H1 | SATMON030 | g2570500 | BLASTN | 365 | 1e−26 | 88 |
| 434 | 2531 | 700163562H1 | SATMON013 | g2570501 | BLASTX | 145 | 1e−24 | 94 |
| 435 | 32364 | 700204306H1 | SATMON003 | g2668745 | BLASTN | 471 | 1e−28 | 74 |
| 436 | 32856 | 700166756H1 | SATMON013 | g534915 | BLASTN | 744 | 1e−53 | 76 |
| 437 | 32856 | 700042535H1 | SATMON004 | g534915 | BLASTN | 644 | 1e−44 | 73 |
| 438 | 3384 | 700237775H1 | SATMON010 | g2258073 | BLASTN | 911 | 1e−67 | 81 |
| 439 | 3384 | 700342456H1 | SATMON021 | g2258073 | BLASTN | 648 | 1e−64 | 78 |
| 440 | 3384 | 700073654H1 | SATMON007 | g2668745 | BLASTN | 860 | 1e−63 | 78 |
| 441 | 3384 | 700577805H1 | SATMON031 | g2258073 | BLASTN | 840 | 1e−61 | 78 |
| 442 | 3384 | 700028881H1 | SATMON003 | g534915 | BLASTN | 835 | 1e−60 | 78 |
| 443 | 3384 | 700215076H1 | SATMON016 | g534915 | BLASTN | 824 | 1e−59 | 78 |
| 444 | 3384 | 700017479H1 | SATMON001 | g534915 | BLASTN | 766 | 1e−55 | 80 |
| 445 | 3384 | 700204495H1 | SATMON003 | g534915 | BLASTN | 373 | 1e−51 | 81 |
| 446 | 3384 | 700206347H1 | SATMON003 | g2706449 | BLASTN | 685 | 1e−48 | 80 |
| 447 | 3384 | 700351040H1 | SATMON023 | g2706449 | BLASTN | 436 | 1e−45 | 78 |
| 448 | 3384 | 700345264H1 | SATMON021 | g2706449 | BLASTN | 616 | 1e−42 | 82 |
| 449 | 3384 | 700196795H1 | SATMON014 | g2570500 | BLASTN | 579 | 1e−39 | 80 |
| 450 | 3384 | 700019241H1 | SATMON001 | g2706449 | BLASTN | 583 | 1e−39 | 78 |
| 451 | 3384 | 700018612H1 | SATMON001 | g2668745 | BLASTN | 518 | 1e−34 | 76 |
| 452 | 3384 | 700102142H1 | SATMON010 | g2668745 | BLASTN | 539 | 1e−34 | 78 |
| 453 | 3384 | 700348430H1 | SATMON023 | g534915 | BLASTN | 489 | 1e−30 | 78 |
| 454 | 3384 | 700337745H1 | SATMON020 | g2706449 | BLASTN | 471 | 1e−28 | 79 |
| 455 | 3384 | 700439515H1 | SATMON026 | g534915 | BLASTN | 437 | 1e−27 | 75 |
| 456 | 3384 | 700074977H1 | SATMON007 | g534915 | BLASTN | 434 | 1e−25 | 76 |
| 457 | 3384 | 700615213H1 | SATMON033 | g2570501 | BLASTX | 125 | 1e−21 | 93 |
| 458 | 3384 | 700074109H1 | SATMON007 | g2668746 | BLASTX | 197 | 1e−20 | 72 |
| 459 | 3384 | 700549517H1 | SATMON022 | g2668746 | BLASTX | 172 | 1e−17 | 75 |

TABLE A*-continued

| Seq No. | Cluster ID | CloneID | Library | NCBI gi | Method | Score | P-value | % Ident |
|---|---|---|---|---|---|---|---|---|
| 460 | 3384 | 700030347H1 | SATMON003 | g2668746 | BLASTX | 171 | 1e-16 | 77 |
| 461 | 3384 | 700221176H1 | SATMON011 | g2668746 | BLASTX | 171 | 1e-16 | 77 |
| 462 | 3384 | 700433360H1 | SATMONN01 | g2668746 | BLASTX | 95 | 1e-13 | 74 |
| 463 | 5000 | 700026151H1 | SATMON003 | g2903 | BLASTX | 261 | 1e-28 | 54 |
| 464 | 5000 | 700347165H1 | SATMON021 | g2624379 | BLASTX | 223 | 1e-24 | 51 |
| 465 | 5000 | 700430341H1 | SATMONN01 | g2903 | BLASTX | 185 | 1e-18 | 56 |
| 466 | 5000 | 700457781H1 | SATMON029 | g2903 | BLASTX | 133 | 1e-16 | 49 |
| 467 | 5861 | 700104993H1 | SATMON010 | g2258073 | BLASTN | 456 | 1e-27 | 73 |
| 468 | 5861 | 700203452H1 | SATMON003 | g2258073 | BLASTN | 428 | 1e-26 | 72 |
| 469 | −L1431590 | LIB143-006-Q1-E1-C9 | LIB143 | g16347 | BLASTN | 286 | 1e-13 | 61 |
| 470 | −L1433414 | LIB143-026-Q1-E1-C3 | LIB143 | g2258073 | BLASTN | 480 | 1e-29 | 70 |
| 471 | −L1482832 | LIB148-009-Q1-E1-D8 | LIB148 | g2258073 | BLASTN | 1086 | 1e-81 | 78 |
| 472 | −L30674379 | LIB3067-042-Q1-K1-H8 | LIB3067 | g2668745 | BLASTN | 305 | 1e-21 | 68 |
| 473 | −L30675678 | LIB3067-034-Q1-K1-E3 | LIB3067 | g2706449 | BLASTN | 286 | 1e-12 | 73 |
| 474 | 107 | LIB3059-036-Q1-K1-B10 | LIB3059 | g2668745 | BLASTN | 1965 | 1e-166 | 100 |
| 475 | 107 | LIB3061-035-Q1-K1-C9 | LIB3061 | g2668745 | BLASTN | 948 | 1e-138 | 93 |
| 476 | 107 | LIB3061-032-Q1-K1-A12 | LIB3061 | g2668745 | BLASTN | 1685 | 1e-138 | 96 |
| 477 | 107 | LIB3062-044-Q1-K1-F8 | LIB3062 | g2668745 | BLASTN | 1492 | 1e-134 | 95 |
| 478 | 107 | LIB3068-025-Q1-K1-E5 | LIB3068 | g2668745 | BLASTN | 1687 | 1e-132 | 96 |
| 479 | 107 | LIB3067-022-Q1-K1-D11 | LIB3067 | g2668745 | BLASTN | 1581 | 1e-128 | 91 |
| 480 | 107 | LIB3067-016-Q1-K1-G4 | LIB3067 | g2668745 | BLASTN | 1305 | 1e-126 | 97 |
| 481 | 107 | LIB3067-029-Q1-K1-C6 | LIB3067 | g2668745 | BLASTN | 1560 | 1e-125 | 90 |
| 482 | 107 | LIB189-031-Q1-E1-D3 | LIB189 | g2668745 | BLASTN | 897 | 1e-81 | 85 |
| 483 | 24066 | LIB3069-047-Q1-K1-C4 | LIB3069 | g166634 | BLASTX | 173 | 1e-45 | 55 |
| 484 | 24266 | LIB3069-006-Q1-K1-F4 | LIB3069 | g2570500 | BLASTN | 717 | 1e-57 | 83 |
| 485 | 293 | LIB3068-043-Q1-K1-A2 | LIB3068 | g633598 | BLASTN | 552 | 1e-34 | 78 |
| 486 | 32364 | LIB3066-001-Q1-K1-B7 | LIB3066 | g2668745 | BLASTN | 612 | 1e-40 | 73 |
| 487 | 32856 | LIB189-028-Q1-E1-C4 | LIB189 | g534915 | BLASTN | 986 | 1e-73 | 73 |
| 488 | 3384 | LIB143-026-Q1-E1-C1 | LIB143 | g534915 | BLASTN | 1284 | 1e-98 | 78 |
| 489 | 3384 | LIB3068-013-Q1-K1-H2 | LIB3068 | g534915 | BLASTN | 1074 | 1e-80 | 78 |
| 490 | 3384 | LIB3062-033-Q1-K1-D2 | LIB3062 | g2668745 | BLASTN | 1009 | 1e-75 | 76 |
| 491 | 3384 | LIB83-002-Q1-E1-D2 | LIB83 | g2706449 | BLASTN | 820 | 1e-59 | 78 |
| 492 | 3384 | LIB3062-057-Q1-K1-B7 | LIB3062 | g2668745 | BLASTN | 801 | 1e-58 | 73 |
| 493 | 3384 | LIB3062-001-Q1-K2-H5 | LIB3062 | g16347 | BLASTN | 802 | 1e-57 | 77 |
| 494 | 3384 | LIB189-022-Q1-E1-D5 | LIB189 | g2668745 | BLASTN | 646 | 1e-43 | 75 |
| 495 | 3384 | LIB189-012-Q1-E1-F4 | LIB189 | g2570501 | BLASTX | 138 | 1e-32 | 72 |
| 496 | 5000 | LIB36-015-Q1-E1-D6 | LIB36 | g2624379 | BLASTX | 236 | 1e-41 | 51 |
| 497 | 5000 | LIB83-016-Q1-E1-H7 | LIB83 | g4198 | BLASTN | 534 | 1e-33 | 61 |
| MAIZE PYROPHOSPHATE-DEPENDENT FRUCTOSE-6-PHOSPHATE PHOSPHOTRANSFERASE | | | | | | | | |
| 498 | −700208959 | 700208959H1 | SATMON016 | g169538 | BLASTX | 107 | 1e-19 | 50 |
| 499 | −700237606 | 700237606H1 | SATMON010 | g169538 | BLASTX | 114 | 1e-11 | 62 |
| 500 | 3456 | 700083478H1 | SATMON011 | g169538 | BLASTX | 121 | 1e-39 | 88 |
| 501 | 3652 | 700242182H1 | SATMON010 | g169538 | BLASTX | 155 | 1e-13 | 82 |
| 502 | 4965 | 700475352H1 | SATMON025 | g169538 | BLASTX | 123 | 1e-9 | 69 |
| 503 | 4965 | 700550752H1 | SATMON022 | g169538 | BLASTX | 123 | 1e-9 | 69 |
| 504 | 5359 | 700347441H1 | SATMON023 | g169538 | BLASTX | 139 | 1e-11 | 70 |

TABLE A*-continued

| Seq No. | Cluster ID | CloneID | Library | NCBI gi | Method | Score | P-value | % Ident |
|---|---|---|---|---|---|---|---|---|
| 505 | −L30594734 | LIB3059-018-Q1-K1-H3 | LIB3059 | g169538 | BLASTX | 145 | 1e−49 | 83 |
| 506 | −L30622375 | LIB3062-009-Q1-K1-B3 | LIB3062 | g169538 | BLASTX | 157 | 1e−30 | 65 |
| 507 | 32156 | L1B189-021-Q1-E1-G8 | LIB189 | g169538 | BLASTX | 123 | 1e−25 | 78 |
| MAIZE INVERTASES | | | | | | | | |
| 508 | −700240132 | 700240132H1 | SATMON010 | g397631 | BLASTX | 134 | 1e−11 | 74 |
| 509 | 1923 | 700574932H1 | SATMON030 | g393390 | BLASTX | 152 | 1e−14 | 65 |
| 510 | 4355 | 700379641H1 | SATMON021 | g1177601 | BLASTX | 175 | 1e−19 | 85 |
| MAIZE SUCROSE SYNTHASE | | | | | | | | |
| 511 | −700151470 | 700151470H1 | SATMON007 | g1196837 | BLASTX | 197 | 1e−27 | 64 |
| 512 | −700214035 | 700214035H1 | SATMON016 | g22485 | BLASTN | 523 | 1e−34 | 79 |
| 513 | −700262270 | 700262270H1 | SATMON017 | g2570066 | BLASTN | 866 | 1e−63 | 76 |
| 514 | −700334686 | 700334686H1 | SATMON019 | g1100216 | BLASTN | 424 | 1e−31 | 88 |
| 515 | −700381593 | 700381593H1 | SATMON023 | g22485 | BLASTN | 219 | 1e−13 | 97 |
| 516 | −700404808 | 700404808H1 | SATMON026 | g2570066 | BLASTN | 859 | 1e−70 | 82 |
| 517 | −700456905 | 700456905H1 | SATMON029 | g22485 | BLASTN | 528 | 1e−64 | 90 |
| 518 | −700571529 | 700571529H1 | SATMON030 | g19106 | BLASTX | 139 | 1e−24 | 56 |
| 519 | −700576567 | 700576567H1 | SATMON030 | g22485 | BLASTN | 285 | 1e−14 | 92 |
| 520 | −700800659 | 700800659H1 | SATMON036 | g22485 | BLASTN | 558 | 1e−37 | 97 |
| 521 | −700802941 | 700802941H1 | SATMON036 | g22485 | BLASTN | 316 | 1e−29 | 97 |
| 522 | −701181030 | 701181030H1 | SATMONN06 | g2606080 | BLASTN | 669 | 1e−46 | 72 |
| 523 | 13723 | 700203023H1 | SATMON003 | g2570066 | BLASTN | 820 | 1e−68 | 84 |
| 524 | 13723 | 700215119H1 | SATMON016 | g2570066 | BLASTN | 680 | 1e−47 | 86 |
| 525 | 13723 | 700473266H1 | SATMON025 | g2570066 | BLASTN | 537 | 1e−35 | 85 |
| 526 | 15661 | 700440404H1 | SATMON026 | g2570066 | BLASTN | 364 | 1e−36 | 74 |
| 527 | 15661 | 700168252H1 | SATMON013 | g16525 | BLASTN | 433 | 1e−27 | 80 |
| 528 | 20925 | 700551647H1 | SATMON022 | g2570066 | BLASTN | 307 | 1e−35 | 73 |
| 529 | 20925 | 700257052H1 | SATMON017 | g2570067 | BLASTX | 118 | 1e−9 | 64 |
| 530 | 20934 | 700217752H1 | SATMON016 | g514945 | BLASTN | 1397 | 1e−107 | 98 |
| 531 | 20934 | 700332156H1 | SATMON019 | g514945 | BLASTN | 589 | 1e−97 | 95 |
| 532 | 30444 | 700257522H1 | SATMON017 | g1100216 | BLASTN | 760 | 1e−54 | 95 |
| 533 | 32909 | 700264718H1 | SATMON017 | g2570066 | BLASTN | 702 | 1e−57 | 76 |
| 534 | 405 | 700091402H1 | SATMON011 | g514945 | BLASTN | 1830 | 1e−143 | 100 |
| 535 | 405 | 700572549H1 | SATMON030 | g514945 | BLASTN | 1658 | 1e−129 | 99 |
| 536 | 405 | 700203058H1 | SATMON003 | g22485 | BLASTN | 1360 | 1e−127 | 100 |
| 537 | 405 | 700091753H1 | SATMON011 | g514945 | BLASTN | 1245 | 1e−126 | 99 |
| 538 | 405 | 700090929H1 | SATMON011 | g514945 | BLASTN | 1620 | 1e−126 | 100 |
| 539 | 405 | 700091711H1 | SATMON011 | g514945 | BLASTN | 1621 | 1e−126 | 99 |
| 540 | 405 | 700084254H1 | SATMON011 | g514945 | BLASTN | 1600 | 1e−124 | 100 |
| 541 | 405 | 700082305H1 | SATMON011 | g514945 | BLASTN | 1601 | 1e−124 | 99 |
| 542 | 405 | 700048236H1 | SATMON003 | g22485 | BLASTN | 1583 | 1e−123 | 99 |
| 543 | 405 | 700086713H1 | SATMON011 | g514945 | BLASTN | 1584 | 1e−123 | 99 |
| 544 | 405 | 700049353H1 | SATMON003 | g514945 | BLASTN | 1586 | 1e−123 | 99 |
| 545 | 405 | 700082766H1 | SATMON011 | g22485 | BLASTN | 1589 | 1e−123 | 98 |
| 546 | 405 | 700086055H1 | SATMON011 | g514945 | BLASTN | 1590 | 1e−123 | 100 |
| 547 | 405 | 700215105H1 | SATMON016 | g514945 | BLASTN | 1590 | 1e−123 | 100 |
| 548 | 405 | 700104149H1 | SATMON010 | g22485 | BLASTN | 1594 | 1e−123 | 98 |
| 549 | 405 | 700101601H1 | SATMON009 | g514945 | BLASTN | 1270 | 1e−122 | 100 |
| 550 | 405 | 700206869H1 | SATMON003 | g22485 | BLASTN | 1574 | 1e−122 | 97 |
| 551 | 405 | 700088163H1 | SATMON011 | g22485 | BLASTN | 1581 | 1e−122 | 99 |
| 552 | 405 | 700089166H1 | SATMON011 | g514945 | BLASTN | 1565 | 1e−121 | 100 |
| 553 | 405 | 700266251H1 | SATMON017 | g514945 | BLASTN | 1570 | 1e−121 | 100 |
| 554 | 405 | 700332710H1 | SATMON019 | g514945 | BLASTN | 1570 | 1e−121 | 100 |
| 555 | 405 | 700571106H1 | SATMON030 | g514945 | BLASTN | 1227 | 1e−120 | 98 |
| 556 | 405 | 700081893H1 | SATMON011 | g514945 | BLASTN | 1550 | 1e−120 | 98 |
| 557 | 405 | 700074739H1 | SATMON007 | g514945 | BLASTN | 1550 | 1e−120 | 100 |
| 558 | 405 | 700095163H1 | SATMON008 | g514945 | BLASTN | 1555 | 1e−120 | 100 |
| 559 | 405 | 700612766H1 | SATMON033 | g514945 | BLASTN | 883 | 1e−119 | 96 |
| 560 | 405 | 700267271H1 | SATMON017 | g514945 | BLASTN | 1535 | 1e−119 | 100 |
| 561 | 405 | 700083175H1 | SATMON011 | g514945 | BLASTN | 1535 | 1e−119 | 100 |
| 562 | 405 | 700088993H1 | SATMON011 | g22485 | BLASTN | 1545 | 1e−119 | 98 |
| 563 | 405 | 700094087H1 | SATMON008 | g22485 | BLASTN | 1526 | 1e−118 | 99 |
| 564 | 405 | 700086708H1 | SATMON011 | g514945 | BLASTN | 1529 | 1e−118 | 97 |
| 565 | 405 | 700090671H1 | SATMON011 | g514945 | BLASTN | 1530 | 1e−118 | 100 |
| 566 | 405 | 700209809H1 | SATMON016 | g22485 | BLASTN | 1532 | 1e−118 | 99 |
| 567 | 405 | 700084625H1 | SATMON011 | g514945 | BLASTN | 1533 | 1e−118 | 99 |
| 568 | 405 | 700089718H1 | SATMON011 | g514945 | BLASTN | 1120 | 1e−117 | 100 |
| 569 | 405 | 700213014H1 | SATMON016 | g514945 | BLASTN | 1405 | 1e−117 | 100 |
| 570 | 405 | 700086555H1 | SATMON011 | g514945 | BLASTN | 1514 | 1e−117 | 98 |
| 571 | 405 | 700475892H1 | SATMON025 | g514945 | BLASTN | 1516 | 1e−117 | 99 |
| 572 | 405 | 700047374H1 | SATMON003 | g22485 | BLASTN | 1516 | 1e−117 | 99 |
| 573 | 405 | 700090018H1 | SATMON011 | g514945 | BLASTN | 1519 | 1e−117 | 99 |
| 574 | 405 | 700076107H1 | SATMON007 | g514945 | BLASTN | 1520 | 1e−117 | 93 |

TABLE A*-continued

| Seq No. | Cluster ID | CloneID | Library | NCBI gi | Method | Score | P-value | % Ident |
|---|---|---|---|---|---|---|---|---|
| 575 | 405 | 700213105H1 | SATMON016 | g514945 | BLASTN | 972 | 1e-116 | 99 |
| 576 | 405 | 700103806H1 | SATMON010 | g514945 | BLASTN | 1503 | 1e-116 | 99 |
| 577 | 405 | 700090748H1 | SATMON011 | g514945 | BLASTN | 1505 | 1e-116 | 100 |
| 578 | 405 | 700052006H1 | SATMON003 | g514945 | BLASTN | 1506 | 1e-116 | 99 |
| 579 | 405 | 700614963H1 | SATMON033 | g514945 | BLASTN | 957 | 1e-115 | 93 |
| 580 | 405 | 700337255H1 | SATMON020 | g22485 | BLASTN | 995 | 1e-115 | 97 |
| 581 | 405 | 700102778H1 | SATMON010 | g22485 | BLASTN | 1493 | 1e-115 | 99 |
| 582 | 405 | 700405466H1 | SATMON029 | g22485 | BLASTN | 1493 | 1e-115 | 99 |
| 583 | 405 | 700209634H1 | SATMON016 | g514945 | BLASTN | 1495 | 1e-115 | 100 |
| 584 | 405 | 700220467H1 | SATMON011 | g514945 | BLASTN | 1495 | 1e-115 | 100 |
| 585 | 405 | 700266637H1 | SATMON017 | g514945 | BLASTN | 1480 | 1e-114 | 100 |
| 586 | 405 | 700267579H1 | SATMON017 | g514945 | BLASTN | 1484 | 1e-114 | 99 |
| 587 | 405 | 700088475H1 | SATMON011 | g514945 | BLASTN | 1465 | 1e-113 | 100 |
| 588 | 405 | 700332618H1 | SATMON019 | g514945 | BLASTN | 1466 | 1e-113 | 99 |
| 589 | 405 | 700211347H1 | SATMON016 | g514945 | BLASTN | 1470 | 1e-113 | 100 |
| 590 | 405 | 700477206H1 | SATMON025 | g514945 | BLASTN | 1471 | 1e-113 | 99 |
| 591 | 405 | 700336768H1 | SATMON019 | g514945 | BLASTN | 1473 | 1e-113 | 99 |
| 592 | 405 | 700105305H1 | SATMON010 | g22485 | BLASTN | 1473 | 1e-113 | 99 |
| 593 | 405 | 700087114H1 | SATMON011 | g514945 | BLASTN | 1473 | 1e-113 | 99 |
| 594 | 405 | 700105366H1 | SATMON010 | g22485 | BLASTN | 1474 | 1e-113 | 98 |
| 595 | 405 | 700104831H1 | SATMON010 | g22485 | BLASTN | 825 | 1e-112 | 98 |
| 596 | 405 | 700620134H1 | SATMON034 | g22485 | BLASTN | 1179 | 1e-112 | 92 |
| 597 | 405 | 700211934H1 | SATMON016 | g22485 | BLASTN | 1215 | 1e-112 | 98 |
| 598 | 405 | 700096103H1 | SATMON008 | g514945 | BLASTN | 1391 | 1e-112 | 99 |
| 599 | 405 | 700264979H1 | SATMON017 | g514945 | BLASTN | 1454 | 1e-112 | 98 |
| 600 | 405 | 700053864H1 | SATMON011 | g514945 | BLASTN | 1455 | 1e-112 | 100 |
| 601 | 405 | 700211782H1 | SATMON016 | g514945 | BLASTN | 1460 | 1e-112 | 100 |
| 602 | 405 | 700102063H1 | SATMON010 | g22485 | BLASTN | 1461 | 1e-112 | 99 |
| 603 | 405 | 700207024H1 | SATMON003 | g514945 | BLASTN | 825 | 1e-111 | 100 |
| 604 | 405 | 700207970H1 | SATMON016 | g514945 | BLASTN | 1186 | 1e-111 | 98 |
| 605 | 405 | 700336624H1 | SATMON019 | g514945 | BLASTN | 1440 | 1e-111 | 100 |
| 606 | 405 | 700104357H1 | SATMON010 | g514945 | BLASTN | 1448 | 1e-111 | 98 |
| 607 | 405 | 700222053H1 | SATMON011 | g514945 | BLASTN | 1449 | 1e-111 | 99 |
| 608 | 405 | 700350806H1 | SATMON023 | g514945 | BLASTN | 660 | 1e-110 | 99 |
| 609 | 405 | 700091159H1 | SATMON011 | g514945 | BLASTN | 870 | 1e-110 | 100 |
| 610 | 405 | 700081810H1 | SATMON011 | g514945 | BLASTN | 926 | 1e-110 | 99 |
| 611 | 405 | 700102954H1 | SATMON010 | g514945 | BLASTN | 926 | 1e-110 | 97 |
| 612 | 405 | 700085307H1 | SATMON011 | g514945 | BLASTN | 1035 | 1e-110 | 100 |
| 613 | 405 | 700094295H1 | SATMON008 | g22485 | BLASTN | 1137 | 1e-110 | 96 |
| 614 | 405 | 700089176H1 | SATMON011 | g514945 | BLASTN | 1393 | 1e-110 | 97 |
| 615 | 405 | 700093643H1 | SATMON008 | g514945 | BLASTN | 1427 | 1e-110 | 95 |
| 616 | 405 | 700082421H1 | SATMON011 | g514945 | BLASTN | 1430 | 1e-110 | 98 |
| 617 | 405 | 700211788H1 | SATMON016 | g514945 | BLASTN | 1431 | 1e-110 | 99 |
| 618 | 405 | 700026724H1 | SATMON003 | g514945 | BLASTN | 1433 | 1e-110 | 97 |
| 619 | 405 | 700085275H1 | SATMON011 | g514945 | BLASTN | 1435 | 1e-110 | 100 |
| 620 | 405 | 700472161H1 | SATMON025 | g514945 | BLASTN | 755 | 1e-109 | 99 |
| 621 | 405 | 700084926H1 | SATMON011 | g514945 | BLASTN | 825 | 1e-109 | 100 |
| 622 | 405 | 700084592H1 | SATMON011 | g514945 | BLASTN | 920 | 1e-109 | 100 |
| 623 | 405 | 700053811H1 | SATMON011 | g514945 | BLASTN | 1296 | 1e-109 | 96 |
| 624 | 405 | 700216963H1 | SATMON016 | g514945 | BLASTN | 1415 | 1e-109 | 100 |
| 625 | 405 | 700085273H1 | SATMON011 | g22485 | BLASTN | 1416 | 1e-109 | 98 |
| 626 | 405 | 700082127H1 | SATMON011 | g514945 | BLASTN | 1420 | 1e-109 | 100 |
| 627 | 405 | 700085731H1 | SATMON011 | g514945 | BLASTN | 1425 | 1e-109 | 100 |
| 628 | 405 | 700088595H1 | SATMON011 | g22485 | BLASTN | 1426 | 1e-109 | 99 |
| 629 | 405 | 700470903H1 | SATMON025 | g514945 | BLASTN | 1426 | 1e-109 | 99 |
| 630 | 405 | 700265288H1 | SATMON017 | g514945 | BLASTN | 1375 | 1e-108 | 100 |
| 631 | 405 | 700072245H1 | SATMON007 | g514945 | BLASTN | 1404 | 1e-108 | 99 |
| 632 | 405 | 700347692H1 | SATMON023 | g514945 | BLASTN | 1405 | 1e-108 | 98 |
| 633 | 405 | 700214447H1 | SATMON016 | g514945 | BLASTN | 1406 | 1e-108 | 99 |
| 634 | 405 | 700476252H1 | SATMON025 | g514945 | BLASTN | 1407 | 1e-108 | 99 |
| 635 | 405 | 700336746H1 | SATMON019 | g514945 | BLASTN | 1409 | 1e-108 | 99 |
| 636 | 405 | 700053833H1 | SATMON011 | g514945 | BLASTN | 1410 | 1e-108 | 100 |
| 637 | 405 | 700094342H1 | SATMON008 | g514945 | BLASTN | 1410 | 1e-108 | 100 |
| 638 | 405 | 700202813H1 | SATMON003 | g514945 | BLASTN | 1032 | 1e-107 | 97 |
| 639 | 405 | 700050589H1 | SATMON003 | g514945 | BLASTN | 1035 | 1e-107 | 100 |
| 640 | 405 | 700050011H1 | SATMON003 | g514945 | BLASTN | 1078 | 1e-107 | 99 |
| 641 | 405 | 700215426H1 | SATMON016 | g514945 | BLASTN | 1189 | 1e-107 | 96 |
| 642 | 405 | 700472461H1 | SATMON025 | g514945 | BLASTN | 1392 | 1e-107 | 99 |
| 643 | 405 | 700336684H1 | SATMON019 | g22485 | BLASTN | 1393 | 1e-107 | 98 |
| 644 | 405 | 700449826H2 | SATMON028 | g514945 | BLASTN | 1395 | 1e-107 | 100 |
| 645 | 405 | 700216443H1 | SATMON016 | g514945 | BLASTN | 1396 | 1e-107 | 99 |
| 646 | 405 | 700240793H1 | SATMON010 | g514945 | BLASTN | 1399 | 1e-107 | 98 |
| 647 | 405 | 700215985H1 | SATMON016 | g514945 | BLASTN | 1400 | 1e-107 | 100 |
| 648 | 405 | 700336740H1 | SATMON019 | g514945 | BLASTN | 915 | 1e-106 | 99 |
| 649 | 405 | 700047958H1 | SATMON003 | g514945 | BLASTN | 987 | 1e-106 | 96 |
| 650 | 405 | 700085447H1 | SATMON011 | g514945 | BLASTN | 1030 | 1e-106 | 100 |
| 651 | 405 | 700084978H1 | SATMON011 | g514945 | BLASTN | 1121 | 1e-106 | 91 |

TABLE A*-continued

| Seq No. | Cluster ID | CloneID | Library | NCBI gi | Method | Score | P-value | % Ident |
|---|---|---|---|---|---|---|---|---|
| 652 | 405 | 700800439H1 | SATMON036 | g22485 | BLASTN | 1379 | 1e-106 | 99 |
| 653 | 405 | 700219631H1 | SATMON011 | g514945 | BLASTN | 1380 | 1e-106 | 100 |
| 654 | 405 | 700220740H1 | SATMON011 | g514945 | BLASTN | 1380 | 1e-106 | 100 |
| 655 | 405 | 700243367H1 | SATMON010 | g514945 | BLASTN | 1381 | 1e-106 | 99 |
| 656 | 405 | 700220363H1 | SATMON011 | g514945 | BLASTN | 1387 | 1e-106 | 99 |
| 657 | 405 | 700215869H1 | SATMON016 | g514945 | BLASTN | 1390 | 1e-106 | 100 |
| 658 | 405 | 700216519H1 | SATMON016 | g514945 | BLASTN | 1131 | 1e-105 | 97 |
| 659 | 405 | 700052206H1 | SATMON003 | g514945 | BLASTN | 1264 | 1e-105 | 96 |
| 660 | 405 | 700094975H1 | SATMON008 | g514945 | BLASTN | 1368 | 1e-105 | 99 |
| 661 | 405 | 700220837H1 | SATMON011 | g514945 | BLASTN | 1369 | 1e-105 | 98 |
| 662 | 405 | 700221108H1 | SATMON011 | g514945 | BLASTN | 1370 | 1e-105 | 98 |
| 663 | 405 | 700222850H1 | SATMON011 | g514945 | BLASTN | 1370 | 1e-105 | 100 |
| 664 | 405 | 700214429H1 | SATMON016 | g514945 | BLASTN | 1373 | 1e-105 | 99 |
| 665 | 405 | 700473857H1 | SATMON025 | g514945 | BLASTN | 1375 | 1e-105 | 98 |
| 666 | 405 | 700213762H1 | SATMON016 | g514945 | BLASTN | 1378 | 1e-105 | 99 |
| 667 | 405 | 700405254H1 | SATMON028 | g22485 | BLASTN | 1242 | 1e-104 | 99 |
| 668 | 405 | 700029978H1 | SATMON003 | g22485 | BLASTN | 1324 | 1e-104 | 97 |
| 669 | 405 | 700238315H1 | SATMON010 | g514945 | BLASTN | 1355 | 1e-104 | 100 |
| 670 | 405 | 700241686H1 | SATMON010 | g514945 | BLASTN | 1358 | 1e-104 | 99 |
| 671 | 405 | 700237721H1 | SATMON010 | g22485 | BLASTN | 1360 | 1e-104 | 100 |
| 672 | 405 | 700217344H1 | SATMON016 | g514945 | BLASTN | 1360 | 1e-104 | 100 |
| 673 | 405 | 700030048H1 | SATMON003 | g514945 | BLASTN | 1363 | 1e-104 | 99 |
| 674 | 405 | 700211866H1 | SATMON016 | g514945 | BLASTN | 1363 | 1e-104 | 99 |
| 675 | 405 | 700214860H1 | SATMON016 | g514945 | BLASTN | 1365 | 1e-104 | 100 |
| 676 | 405 | 700085490H1 | SATMON011 | g514945 | BLASTN | 900 | 1e-103 | 98 |
| 677 | 405 | 700048568H1 | SATMON003 | g514945 | BLASTN | 980 | 1e-103 | 100 |
| 678 | 405 | 700381034H1 | SATMON023 | g22485 | BLASTN | 1269 | 1e-103 | 98 |
| 679 | 405 | 700220930H1 | SATMON011 | g514945 | BLASTN | 1347 | 1e-103 | 99 |
| 680 | 405 | 700030261H1 | SATMON003 | g514945 | BLASTN | 1353 | 1e-103 | 98 |
| 681 | 405 | 700081835H1 | SATMON011 | g22485 | BLASTN | 797 | 1e-102 | 98 |
| 682 | 405 | 700205270H1 | SATMON003 | g514945 | BLASTN | 1024 | 1e-102 | 94 |
| 683 | 405 | 700093612H1 | SATMON008 | g514945 | BLASTN | 1065 | 1e-102 | 99 |
| 684 | 405 | 700333392H1 | SATMON019 | g514945 | BLASTN | 1108 | 1e-102 | 97 |
| 685 | 405 | 700575385H1 | SATMON030 | g514945 | BLASTN | 1171 | 1e-102 | 96 |
| 686 | 405 | 700241061H1 | SATMON010 | g514945 | BLASTN | 1174 | 1e-102 | 99 |
| 687 | 405 | 700239916H1 | SATMON010 | g514945 | BLASTN | 1255 | 1e-102 | 100 |
| 688 | 405 | 700090248H1 | SATMON011 | g514945 | BLASTN | 1334 | 1e-102 | 98 |
| 689 | 405 | 700222923H1 | SATMON011 | g514945 | BLASTN | 1334 | 1e-102 | 98 |
| 690 | 405 | 700216993H1 | SATMON016 | g514945 | BLASTN | 1335 | 1e-102 | 100 |
| 691 | 405 | 700215984H1 | SATMON016 | g514945 | BLASTN | 1340 | 1e-102 | 100 |
| 692 | 405 | 700213182H1 | SATMON016 | g514945 | BLASTN | 1340 | 1e-102 | 98 |
| 693 | 405 | 700219845H1 | SATMON011 | g514945 | BLASTN | 1340 | 1e-102 | 100 |
| 694 | 405 | 700237762H1 | SATMON010 | g514945 | BLASTN | 1340 | 1e-102 | 100 |
| 695 | 405 | 700551043H1 | SATMON022 | g514945 | BLASTN | 1342 | 1e-102 | 99 |
| 696 | 405 | 700219254H1 | SATMON011 | g514945 | BLASTN | 1252 | 1e-101 | 99 |
| 697 | 405 | 700210348H1 | SATMON016 | g514945 | BLASTN | 1320 | 1e-101 | 97 |
| 698 | 405 | 700215089H1 | SATMON016 | g514945 | BLASTN | 1320 | 1e-101 | 100 |
| 699 | 405 | 700217251H1 | SATMON016 | g514945 | BLASTN | 1320 | 1e-101 | 100 |
| 700 | 405 | 700219240H1 | SATMON011 | g514945 | BLASTN | 1320 | 1e-101 | 100 |
| 701 | 405 | 700082094H1 | SATMON011 | g514945 | BLASTN | 1321 | 1e-101 | 99 |
| 702 | 405 | 700219385H1 | SATMON011 | g514945 | BLASTN | 1322 | 1e-101 | 99 |
| 703 | 405 | 700220052H1 | SATMON011 | g514945 | BLASTN | 1325 | 1e-101 | 100 |
| 704 | 405 | 700210366H1 | SATMON016 | g514945 | BLASTN | 1329 | 1e-101 | 93 |
| 705 | 405 | 700083089H1 | SATMON011 | g514945 | BLASTN | 1330 | 1e-101 | 98 |
| 706 | 405 | 700340286H1 | SATMON020 | g22485 | BLASTN | 677 | 1e-100 | 98 |
| 707 | 405 | 700221062H1 | SATMON011 | g514945 | BLASTN | 845 | 1e-100 | 98 |
| 708 | 405 | 700382272H1 | SATMON024 | g22485 | BLASTN | 958 | 1e-100 | 96 |
| 709 | 405 | 700209310H1 | SATMON016 | g514945 | BLASTN | 1187 | 1e-100 | 97 |
| 710 | 405 | 700052340H1 | SATMON003 | g514945 | BLASTN | 1188 | 1e-100 | 94 |
| 711 | 405 | 700467851H1 | SATMON025 | g22485 | BLASTN | 1245 | 1e-100 | 97 |
| 712 | 405 | 700088014H1 | SATMON011 | g514945 | BLASTN | 1270 | 1e-100 | 98 |
| 713 | 405 | 700214596H1 | SATMON016 | g514945 | BLASTN | 1295 | 1e-100 | 100 |
| 714 | 405 | 700157215H1 | SATMON012 | g22485 | BLASTN | 1310 | 1e-100 | 98 |
| 715 | 405 | 700223892H1 | SATMON011 | g514945 | BLASTN | 1310 | 1e-100 | 100 |
| 716 | 405 | 700218981H1 | SATMON011 | g514945 | BLASTN | 1310 | 1e-100 | 100 |
| 717 | 405 | 700081945H1 | SATMON011 | g514945 | BLASTN | 1311 | 1e-100 | 96 |
| 718 | 405 | 700217817H1 | SATMON016 | g514945 | BLASTN | 1315 | 1e-100 | 100 |
| 719 | 405 | 700469042H1 | SATMON025 | g514945 | BLASTN | 561 | 1e-99 | 98 |
| 720 | 405 | 700474709H1 | SATMON025 | g514945 | BLASTN | 801 | 1e-99 | 99 |
| 721 | 405 | 700201736H1 | SATMON003 | g514945 | BLASTN | 1168 | 1e-99 | 98 |
| 722 | 405 | 700223516H1 | SATMON011 | g514945 | BLASTN | 1201 | 1e-99 | 99 |
| 723 | 405 | 700453941H1 | SATMON029 | g22485 | BLASTN | 1295 | 1e-99 | 95 |
| 724 | 405 | 700212970H1 | SATMON016 | g514945 | BLASTN | 1297 | 1e-99 | 99 |
| 725 | 405 | 700215662H1 | SATMON016 | g22485 | BLASTN | 1297 | 1e-99 | 99 |
| 726 | 405 | 700802209H1 | SATMON036 | g22485 | BLASTN | 1300 | 1e-99 | 98 |
| 727 | 405 | 700343716H1 | SATMON021 | g514945 | BLASTN | 1300 | 1e-99 | 100 |
| 728 | 405 | 700223322H1 | SATMON011 | g514945 | BLASTN | 1300 | 1e-99 | 100 |

TABLE A*-continued

| Seq No. | Cluster ID | CloneID | Library | NCBI gi | Method | Score | P-value | % Ident |
|---|---|---|---|---|---|---|---|---|
| 729 | 405 | 700217238H1 | SATMON016 | g514945 | BLASTN | 1300 | 1e−99 | 100 |
| 730 | 405 | 700195066H1 | SATMON014 | g22485 | BLASTN | 1300 | 1e−99 | 98 |
| 731 | 405 | 700072395H1 | SATMON007 | g514945 | BLASTN | 1301 | 1e−99 | 95 |
| 732 | 405 | 700212752H1 | SATMON016 | g22485 | BLASTN | 1305 | 1e−99 | 98 |
| 733 | 405 | 700222204H1 | SATMON011 | g514945 | BLASTN | 1305 | 1e−99 | 100 |
| 734 | 405 | 700550572H1 | SATMON022 | g22485 | BLASTN | 713 | 1e−98 | 97 |
| 735 | 405 | 700213879H1 | SATMON016 | g514945 | BLASTN | 866 | 1e−98 | 99 |
| 736 | 405 | 700551585H1 | SATMON022 | g514945 | BLASTN | 916 | 1e−98 | 99 |
| 737 | 405 | 700195025H1 | SATMON014 | g22485 | BLASTN | 1283 | 1e−98 | 98 |
| 738 | 405 | 700800710H1 | SATMON036 | g22485 | BLASTN | 1283 | 1e−98 | 98 |
| 739 | 405 | 700222985H1 | SATMON011 | g22485 | BLASTN | 1283 | 1e−98 | 98 |
| 740 | 405 | 700798823H1 | SATMON036 | g22485 | BLASTN | 1284 | 1e−98 | 98 |
| 741 | 405 | 700104391H1 | SATMON010 | g22485 | BLASTN | 1289 | 1e−98 | 98 |
| 742 | 405 | 700466592H1 | SATMON025 | g22485 | BLASTN | 1289 | 1e−98 | 95 |
| 743 | 405 | 700027037H1 | SATMON003 | g514945 | BLASTN | 919 | 1e−97 | 91 |
| 744 | 405 | 700214371H1 | SATMON016 | g514945 | BLASTN | 1033 | 1e−97 | 95 |
| 745 | 405 | 700799077H1 | SATMON036 | g22485 | BLASTN | 1091 | 1e−97 | 99 |
| 746 | 405 | 700467028H1 | SATMON025 | g22485 | BLASTN | 1103 | 1e−97 | 98 |
| 747 | 405 | 700219393H1 | SATMON011 | g514945 | BLASTN | 1250 | 1e−97 | 99 |
| 748 | 405 | 700197602H1 | SATMON014 | g22485 | BLASTN | 1273 | 1e−97 | 97 |
| 749 | 405 | 700801226H1 | SATMON036 | g22485 | BLASTN | 1276 | 1e−97 | 99 |
| 750 | 405 | 700216371H1 | SATMON016 | g514945 | BLASTN | 1278 | 1e−97 | 98 |
| 751 | 405 | 700805695H1 | SATMON036 | g22485 | BLASTN | 1280 | 1e−97 | 98 |
| 752 | 405 | 700334076H1 | SATMON019 | g514945 | BLASTN | 503 | 1e−96 | 98 |
| 753 | 405 | 700082647H1 | SATMON011 | g514945 | BLASTN | 735 | 1e−96 | 100 |
| 754 | 405 | 700458687H1 | SATMON029 | g22485 | BLASTN | 751 | 1e−96 | 95 |
| 755 | 405 | 700220750H1 | SATMON011 | g514945 | BLASTN | 1187 | 1e−96 | 96 |
| 756 | 405 | 700194931H1 | SATMON014 | g22485 | BLASTN | 1262 | 1e−96 | 99 |
| 757 | 405 | 700800522H1 | SATMON036 | g22485 | BLASTN | 1265 | 1e−96 | 98 |
| 758 | 405 | 700244185H1 | SATMON010 | g514945 | BLASTN | 1265 | 1e−96 | 100 |
| 759 | 405 | 700240785H1 | SATMON010 | g514945 | BLASTN | 1268 | 1e−96 | 98 |
| 760 | 405 | 700551959H1 | SATMON022 | g514945 | BLASTN | 1270 | 1e−96 | 100 |
| 761 | 405 | 700085057H1 | SATMON011 | g514945 | BLASTN | 682 | 1e−95 | 97 |
| 762 | 405 | 700332020H1 | SATMON019 | g514945 | BLASTN | 713 | 1e−95 | 97 |
| 763 | 405 | 700208841H1 | SATMON016 | g514945 | BLASTN | 822 | 1e−95 | 95 |
| 764 | 405 | 700193023H1 | SATMON014 | g22485 | BLASTN | 1248 | 1e−95 | 98 |
| 765 | 405 | 700153902H1 | SATMON007 | g514945 | BLASTN | 1250 | 1e−95 | 100 |
| 766 | 405 | 700196173H1 | SATMON014 | g22485 | BLASTN | 1252 | 1e−95 | 99 |
| 767 | 405 | 700804187H1 | SATMON036 | g22485 | BLASTN | 1253 | 1e−95 | 98 |
| 768 | 405 | 700339656H1 | SATMON020 | g22485 | BLASTN | 1257 | 1e−95 | 99 |
| 769 | 405 | 700238537H1 | SATMON010 | g22485 | BLASTN | 1258 | 1e−95 | 99 |
| 770 | 405 | 700551221H1 | SATMON022 | g514945 | BLASTN | 1204 | 1e−94 | 99 |
| 771 | 405 | 700801807H1 | SATMON036 | g22485 | BLASTN | 1235 | 1e−94 | 100 |
| 772 | 405 | 700085096H1 | SATMON011 | g514945 | BLASTN | 1235 | 1e−94 | 100 |
| 773 | 405 | 700020516H1 | SATMON001 | g514945 | BLASTN | 1236 | 1e−94 | 98 |
| 774 | 405 | 700193482H1 | SATMON014 | g22485 | BLASTN | 1236 | 1e−94 | 99 |
| 775 | 405 | 700217793H1 | SATMON016 | g514945 | BLASTN | 1237 | 1e−94 | 98 |
| 776 | 405 | 700088752H1 | SATMON011 | g514945 | BLASTN | 1240 | 1e−94 | 100 |
| 777 | 405 | 700087940H1 | SATMON011 | g514945 | BLASTN | 1241 | 1e−94 | 99 |
| 778 | 405 | 700089541H1 | SATMON011 | g533251 | BLASTN | 1067 | 1e−93 | 91 |
| 779 | 405 | 700346461H1 | SATMON021 | g514945 | BLASTN | 1190 | 1e−93 | 99 |
| 780 | 405 | 700156258H1 | SATMON007 | g514945 | BLASTN | 1225 | 1e−93 | 100 |
| 781 | 405 | 700195532H1 | SATMON014 | g22485 | BLASTN | 1226 | 1e−93 | 99 |
| 782 | 405 | 700196548H1 | SATMON014 | g22485 | BLASTN | 1227 | 1e−93 | 99 |
| 783 | 405 | 700213282H1 | SATMON016 | g514945 | BLASTN | 1227 | 1e−93 | 96 |
| 784 | 405 | 700194939H1 | SATMON014 | g22485 | BLASTN | 1228 | 1e−93 | 98 |
| 785 | 405 | 700340787H1 | SATMON020 | g22485 | BLASTN | 697 | 1e−92 | 94 |
| 786 | 405 | 700105064H1 | SATMON010 | g22485 | BLASTN | 706 | 1e−92 | 98 |
| 787 | 405 | 700805132H1 | SATMON036 | g22485 | BLASTN | 1046 | 1e−92 | 99 |
| 788 | 405 | 700803414H1 | SATMON036 | g22485 | BLASTN | 1211 | 1e−92 | 99 |
| 789 | 405 | 700214594H1 | SATMON016 | g514945 | BLASTN | 1212 | 1e−92 | 98 |
| 790 | 405 | 700215080H1 | SATMON016 | g514945 | BLASTN | 1213 | 1e−92 | 92 |
| 791 | 405 | 700224219H1 | SATMON011 | g514945 | BLASTN | 1213 | 1e−92 | 99 |
| 792 | 405 | 700048190H1 | SATMON003 | g514945 | BLASTN | 1218 | 1e−92 | 92 |
| 793 | 405 | 700223284H1 | SATMON011 | g51494S | BLASTN | 1220 | 1e−92 | 100 |
| 794 | 405 | 700152413H1 | SATMON007 | g514945 | BLASTN | 1220 | 1e−92 | 100 |
| 795 | 405 | 700218003H1 | SATMON016 | g514945 | BLASTN | 1221 | 1e−92 | 96 |
| 796 | 405 | 700160155H1 | SATMON012 | g22485 | BLASTN | 1222 | 1e−92 | 99 |
| 797 | 405 | 700087943H1 | SATMON011 | g22485 | BLASTN | 1222 | 1e−92 | 99 |
| 798 | 405 | 700474049H1 | SATMON025 | g514945 | BLASTN | 632 | 1e−91 | 97 |
| 799 | 405 | 700216994H1 | SATMON016 | g514945 | BLASTN | 1043 | 1e−91 | 99 |
| 800 | 405 | 700346892H1 | SATMON021 | g514945 | BLASTN | 1210 | 1e−91 | 96 |
| 801 | 405 | 700142782H1 | SATMON013 | g514945 | BLASTN | 1190 | 1e−90 | 100 |
| 802 | 405 | 700244157H1 | SATMON010 | g514945 | BLASTN | 1197 | 1e−90 | 97 |
| 803 | 405 | 700469243H1 | SATMON025 | g22485 | BLASTN | 701 | 1e−89 | 98 |
| 804 | 405 | 700618387H1 | SATMON033 | g514945 | BLASTN | 853 | 1e−89 | 93 |
| 805 | 405 | 700211154H1 | SATMON016 | g5332S1 | BLASTN | 917 | 1e−89 | 90 |

TABLE A*-continued

| Seq No. | Cluster ID | CloneID | Library | NCBI gi | Method | Score | P-value | % Ident |
|---|---|---|---|---|---|---|---|---|
| 806 | 405 | 700081933H1 | SATMON011 | g533251 | BLASTN | 955 | 1e-89 | 91 |
| 807 | 405 | 700235229H1 | SATMON010 | g514945 | BLASTN | 955 | 1e-89 | 97 |
| 808 | 405 | 700209241H1 | SATMON016 | g514945 | BLASTN | 1076 | 1e-89 | 98 |
| 809 | 405 | 700265841H1 | SATMON017 | g514945 | BLASTN | 1097 | 1e-89 | 95 |
| 810 | 405 | 700193804H1 | SATMON014 | g22485 | BLASTN | 1180 | 1e-89 | 98 |
| 811 | 405 | 700167742H1 | SATMON013 | g22485 | BLASTN | 1180 | 1e-89 | 100 |
| 812 | 405 | 700163256H1 | SATMON013 | g514945 | BLASTN | 1182 | 1e-89 | 97 |
| 813 | 405 | 700184973H1 | SATMON014 | g22485 | BLASTN | 1182 | 1e-89 | 99 |
| 814 | 405 | 700171785H1 | SATMON013 | g22485 | BLASTN | 1184 | 1e-89 | 97 |
| 815 | 405 | 700216915H1 | SATMON016 | g514945 | BLASTN | 1185 | 1e-89 | 100 |
| 816 | 405 | 700806685H1 | SATMON036 | g22485 | BLASTN | 1186 | 1e-89 | 99 |
| 817 | 405 | 700803846H1 | SATMON036 | g22485 | BLASTN | 892 | 1e-88 | 95 |
| 818 | 405 | 700218514H1 | SATMON011 | g533251 | BLASTN | 907 | 1e-88 | 91 |
| 819 | 405 | 700574674H1 | SATMON030 | g22485 | BLASTN | 957 | 1e-88 | 84 |
| 820 | 405 | 700196082H1 | SATMON014 | g22485 | BLASTN | 1054 | 1e-88 | 94 |
| 821 | 405 | 700241637H1 | SATMON010 | g22485 | BLASTN | 1081 | 1e-88 | 98 |
| 822 | 405 | 700801876H1 | SATMON036 | g22485 | BLASTN | 1163 | 1e-88 | 98 |
| 823 | 405 | 700213443H1 | SATMON016 | g514945 | BLASTN | 1171 | 1e-88 | 99 |
| 824 | 405 | 700465181H1 | SATMON025 | g22485 | BLASTN | 797 | 1e-87 | 92 |
| 825 | 405 | 700798732H1 | SATMON036 | g22485 | BLASTN | 1159 | 1e-87 | 96 |
| 826 | 405 | 700153473H1 | SATMON007 | g514945 | BLASTN | 1160 | 1e-87 | 100 |
| 827 | 405 | 700165496H1 | SATMON013 | g514945 | BLASTN | 1160 | 1e-87 | 97 |
| 828 | 405 | 700264250H1 | SATMON017 | g514945 | BLASTN | 643 | 1e-86 | 100 |
| 829 | 405 | 700335490H1 | SATMON019 | g514945 | BLASTN | 671 | 1e-86 | 97 |
| 830 | 405 | 700575891H1 | SATMON030 | g22485 | BLASTN | 780 | 1e-86 | 92 |
| 831 | 405 | 700222931H1 | SATMON011 | g514945 | BLASTN | 1117 | 1e-86 | 91 |
| 832 | 405 | 700163588H1 | SATMON013 | g514945 | BLASTN | 1140 | 1e-86 | 100 |
| 833 | 405 | 700161111H1 | SATMON012 | g22485 | BLASTN | 1142 | 1e-86 | 99 |
| 834 | 405 | 700016023H1 | SATMON001 | g514945 | BLASTN | 1147 | 1e-86 | 99 |
| 835 | 405 | 700209043H1 | SATMON016 | g514945 | BLASTN | 659 | 1e-85 | 98 |
| 836 | 405 | 700333556H1 | SATMON019 | g514945 | BLASTN | 783 | 1e-85 | 89 |
| 837 | 405 | 700570471H1 | SATMON030 | g22485 | BLASTN | 831 | 1e-85 | 89 |
| 838 | 405 | 700171040H1 | SATMON013 | g22485 | BLASTN | 1127 | 1e-85 | 99 |
| 839 | 405 | 700196146H1 | SATMON014 | g22485 | BLASTN | 1128 | 1e-85 | 96 |
| 840 | 405 | 700021837H1 | SATMON001 | g514945 | BLASTN | 1130 | 1e-85 | 98 |
| 841 | 405 | 700169062H1 | SATMON013 | g514945 | BLASTN | 1130 | 1e-85 | 100 |
| 842 | 405 | 700218263H1 | SATMON016 | g514945 | BLASTN | 1135 | 1e-85 | 100 |
| 843 | 405 | 700091281H1 | SATMON011 | g514945 | BLASTN | 1135 | 1e-85 | 100 |
| 844 | 405 | 700221221H1 | SATMON011 | g22485 | BLASTN | 735 | 1e-84 | 98 |
| 845 | 405 | 700239933H1 | SATMON010 | g22485 | BLASTN | 779 | 1e-84 | 97 |
| 846 | 405 | 700193089H1 | SATMON014 | g22485 | BLASTN | 979 | 1e-84 | 97 |
| 847 | 405 | 700216767H1 | SATMON016 | g514945 | BLASTN | 1005 | 1e-84 | 98 |
| 848 | 405 | 700085786H1 | SATMON011 | g514945 | BLASTN | 1117 | 1e-84 | 99 |
| 849 | 405 | 700163868H1 | SATMON013 | g22485 | BLASTN | 1120 | 1e-84 | 100 |
| 850 | 405 | 700167028H1 | SATMON013 | g514945 | BLASTN | 1120 | 1e-84 | 100 |
| 851 | 405 | 700170416H1 | SATMON013 | g514945 | BLASTN | 1120 | 1e-84 | 100 |
| 852 | 405 | 700266595H1 | SATMON017 | g514945 | BLASTN | 1120 | 1e-84 | 100 |
| 853 | 405 | 700377630H1 | SATMON019 | g514945 | BLASTN | 649 | 1e-83 | 95 |
| 854 | 405 | 700207830H1 | SATMON016 | g514945 | BLASTN | 877 | 1e-83 | 97 |
| 855 | 405 | 700241726H1 | SATMON010 | g514945 | BLASTN | 1104 | 1e-83 | 97 |
| 856 | 405 | 700806447H1 | SATMON036 | g22485 | BLASTN | 1106 | 1e-83 | 93 |
| 857 | 405 | 700018166H1 | SATMON001 | g514945 | BLASTN | 1108 | 1e-83 | 98 |
| 858 | 405 | 700083463H1 | SATMON011 | g514945 | BLASTN | 633 | 1e-82 | 92 |
| 859 | 405 | 700548890H1 | SATMON022 | g22485 | BLASTN | 727 | 1e-82 | 93 |
| 860 | 405 | 700218553H1 | SATMON011 | g22485 | BLASTN | 979 | 1e-82 | 95 |
| 861 | 405 | 700016408H1 | SATMON001 | g514945 | BLASTN | 1026 | 1e-82 | 97 |
| 862 | 405 | 700569427H2 | SATMON030 | g514945 | BLASTN | 1095 | 1e-82 | 97 |
| 863 | 405 | 700172546H1 | SATMON013 | g514945 | BLASTN | 1100 | 1e-82 | 100 |
| 864 | 405 | 700804387H1 | SATMON036 | g22485 | BLASTN | 668 | 1e-81 | 97 |
| 865 | 405 | 700155788H1 | SATMON007 | g514945 | BLASTN | 840 | 1e-81 | 100 |
| 866 | 405 | 700807167H1 | SATMON036 | g22485 | BLASTN | 1024 | 1e-81 | 97 |
| 867 | 405 | 700472356H1 | SATMON025 | g22485 | BLASTN | 1080 | 1e-81 | 98 |
| 868 | 405 | 700193535H1 | SATMON014 | g22485 | BLASTN | 1082 | 1e-81 | 99 |
| 869 | 405 | 700171177H1 | SATMON013 | g22485 | BLASTN | 1086 | 1e-81 | 98 |
| 870 | 405 | 700799867H1 | SATMON036 | g22485 | BLASTN | 1087 | 1e-81 | 96 |
| 871 | 405 | 700263716H1 | SATMON017 | g514945 | BLASTN | 1089 | 1e-81 | 92 |
| 872 | 405 | 700476045H1 | SATMON025 | g22485 | BLASTN | 608 | 1e-80 | 88 |
| 873 | 405 | 700803344H1 | SATMON036 | g22485 | BLASTN | 834 | 1e-80 | 97 |
| 874 | 405 | 700168924H1 | SATMON013 | g514945 | BLASTN | 860 | 1e-80 | 99 |
| 875 | 405 | 700218569H1 | SATMON011 | g22485 | BLASTN | 900 | 1e-80 | 98 |
| 876 | 405 | 700088574H1 | SATMON011 | g514945 | BLASTN | 900 | 1e-80 | 86 |
| 877 | 405 | 700471932H1 | SATMON025 | g530978 | BLASTN | 1064 | 1e-80 | 83 |
| 878 | 405 | 700020011H1 | SATMON001 | g22485 | BLASTN | 1067 | 1e-80 | 99 |
| 879 | 405 | 700167511H1 | SATMON013 | g22485 | BLASTN | 1070 | 1e-80 | 100 |
| 880 | 405 | 700219249H1 | SATMON011 | g514945 | BLASTN | 1070 | 1e-80 | 100 |
| 881 | 405 | 700804846H1 | SATMON036 | g22485 | BLASTN | 1075 | 1e-80 | 90 |
| 882 | 405 | 700150388H1 | SATMON007 | g22485 | BLASTN | 1075 | 1e-80 | 100 |

TABLE A*-continued

| Seq No. | Cluster ID | CloneID | Library | NCBI gi | Method | Score | P-value | % Ident |
|---|---|---|---|---|---|---|---|---|
| 883 | 405 | 700807395H1 | SATMON036 | g22485 | BLASTN | 571 | 1e−79 | 90 |
| 884 | 405 | 700090864H1 | SATMON011 | g514945 | BLASTN | 630 | 1e−79 | 100 |
| 885 | 405 | 700217812H1 | SATMON016 | g514945 | BLASTN | 646 | 1e−79 | 91 |
| 886 | 405 | 700203618H1 | SATMON003 | g22485 | BLASTN | 913 | 1e−79 | 96 |
| 887 | 405 | 700203302H1 | SATMON003 | g514945 | BLASTN | 1030 | 1e−79 | 100 |
| 888 | 405 | 700163192H1 | SATMON013 | g22485 | BLASTN | 1056 | 1e−79 | 97 |
| 889 | 405 | 700805065H1 | SATMON036 | g22485 | BLASTN | 1066 | 1e−79 | 95 |
| 890 | 405 | 700086763H1 | SATMON011 | g514945 | BLASTN | 901 | 1e−78 | 98 |
| 891 | 405 | 700240070H1 | SATMON010 | g533251 | BLASTN | 923 | 1e−78 | 90 |
| 892 | 405 | 700018847H1 | SATMON001 | g22485 | BLASTN | 1045 | 1e−78 | 98 |
| 893 | 405 | 700803420H1 | SATMON036 | g22485 | BLASTN | 1048 | 1e−78 | 96 |
| 894 | 405 | 700799936H1 | SATMON036 | g22485 | BLASTN | 1050 | 1e−78 | 96 |
| 895 | 405 | 700207637H1 | SATMON016 | g514945 | BLASTN | 828 | 1e−77 | 98 |
| 896 | 405 | 700807034H1 | SATMON036 | g22485 | BLASTN | 808 | 1e−76 | 91 |
| 897 | 405 | 700198035H1 | SATMON016 | g514945 | BLASTN | 1025 | 1e−76 | 100 |
| 898 | 405 | 700169076H1 | SATMON013 | g514945 | BLASTN | 1028 | 1e−76 | 99 |
| 899 | 405 | 700020564H1 | SATMON001 | g514945 | BLASTN | 1030 | 1e−76 | 98 |
| 900 | 405 | 700799968H1 | SATMON036 | g22485 | BLASTN | 701 | 1e−75 | 99 |
| 901 | 405 | 700378056H1 | SATMON019 | g22485 | BLASTN | 802 | 1e−75 | 97 |
| 902 | 405 | 700219691H1 | SATMON011 | g514945 | BLASTN | 1018 | 1e−75 | 99 |
| 903 | 405 | 700168945H1 | SATMON013 | g22485 | BLASTN | 848 | 1e−74 | 94 |
| 904 | 405 | 700242730H1 | SATMON010 | g514945 | BLASTN | 1006 | 1e−74 | 99 |
| 905 | 405 | 700210096H1 | SATMON016 | g514945 | BLASTN | 756 | 1e−73 | 93 |
| 906 | 405 | 700333941H1 | SATMON019 | g514945 | BLASTN | 923 | 1e−73 | 99 |
| 907 | 405 | 700576645H1 | SATMON030 | g22485 | BLASTN | 991 | 1e−73 | 99 |
| 908 | 405 | 700333494H1 | SATMON019 | g514945 | BLASTN | 601 | 1e−72 | 91 |
| 909 | 405 | 700023296H1 | SATMON003 | g514945 | BLASTN | 726 | 1e−72 | 95 |
| 910 | 405 | 700802508H1 | SATMON036 | g22485 | BLASTN | 811 | 1e−72 | 94 |
| 911 | 405 | 700223382H1 | SATMON011 | g22485 | BLASTN | 865 | 1e−72 | 98 |
| 912 | 405 | 700215535H1 | SATMON016 | g514945 | BLASTN | 942 | 1e−72 | 96 |
| 913 | 405 | 700017549H1 | SATMON001 | g514945 | BLASTN | 973 | 1e−72 | 97 |
| 914 | 405 | 700799113H1 | SATMON036 | g22485 | BLASTN | 787 | 1e−70 | 99 |
| 915 | 405 | 700168696H1 | SATMON013 | g514945 | BLASTN | 946 | 1e−69 | 89 |
| 916 | 405 | 700088269H1 | SATMON011 | g514945 | BLASTN | 946 | 1e−69 | 93 |
| 917 | 405 | 700194522H1 | SATMON014 | g22485 | BLASTN | 875 | 1e−68 | 97 |
| 918 | 405 | 700203476H1 | SATMON003 | g22485 | BLASTN | 923 | 1e−68 | 86 |
| 919 | 405 | 700549205H1 | SATMON022 | g22485 | BLASTN | 300 | 1e−66 | 89 |
| 920 | 405 | 700196217H1 | SATMON014 | g22485 | BLASTN | 907 | 1e−66 | 96 |
| 921 | 405 | 700163647H1 | SATMON013 | g22485 | BLASTN | 888 | 1e−65 | 98 |
| 922 | 405 | 700804485H1 | SATMON036 | g22485 | BLASTN | 896 | 1e−65 | 99 |
| 923 | 405 | 700193074H1 | SATMON014 | g22485 | BLASTN | 605 | 1e−63 | 96 |
| 924 | 405 | 700203370H1 | SATMON003 | g514945 | BLASTN | 857 | 1e−62 | 98 |
| 925 | 405 | 700201575H1 | SATMON003 | g514945 | BLASTN | 335 | 1e−60 | 87 |
| 926 | 405 | 700378020H1 | SATMON019 | g514945 | BLASTN | 833 | 1e−60 | 97 |
| 927 | 405 | 700242865H1 | SATMON010 | g514945 | BLASTN | 823 | 1e−59 | 91 |
| 928 | 405 | 700344036H1 | SATMON021 | g514945 | BLASTN | 825 | 1e−59 | 100 |
| 929 | 405 | 700215849H1 | SATMON016 | g514945 | BLASTN | 805 | 1e−58 | 100 |
| 930 | 405 | 700443538H1 | SATMON027 | g22485 | BLASTN | 814 | 1e−58 | 98 |
| 931 | 405 | 700804448H1 | SATMON036 | g22485 | BLASTN | 791 | 1e−57 | 99 |
| 932 | 405 | 700155008H1 | SATMON007 | g22485 | BLASTN | 802 | 1e−57 | 98 |
| 933 | 405 | 700201244H1 | SATMON003 | g22485 | BLASTN | 530 | 1e−56 | 97 |
| 934 | 405 | 700616378H1 | SATMON033 | g22485 | BLASTN | 682 | 1e−56 | 97 |
| 935 | 405 | 700333357H1 | SATMON019 | g22485 | BLASTN | 780 | 1e−56 | 80 |
| 936 | 405 | 700222360H1 | SATMON011 | g514945 | BLASTN | 777 | 1e−55 | 92 |
| 937 | 405 | 700214724H1 | SATMON016 | g514945 | BLASTN | 763 | 1e−54 | 98 |
| 938 | 405 | 700571283H1 | SATMON030 | g514945 | BLASTN | 736 | 1e−52 | 99 |
| 939 | 405 | 700020194H1 | SATMON001 | g22485 | BLASTN | 415 | 1e−51 | 99 |
| 940 | 405 | 700620551H1 | SATMON034 | g22485 | BLASTN | 473 | 1e−51 | 95 |
| 941 | 405 | 700446320H1 | SATMON027 | g22485 | BLASTN | 475 | 1e−50 | 87 |
| 942 | 405 | 700241357H1 | SATMON010 | g22485 | BLASTN | 701 | 1e−49 | 99 |
| 943 | 405 | 700617094H1 | SATMON033 | g22485 | BLASTN | 673 | 1e−47 | 97 |
| 944 | 405 | 700206691H1 | SATMON003 | g514945 | BLASTN | 680 | 1e−47 | 90 |
| 945 | 405 | 700091580H1 | SATMON011 | g514945 | BLASTN | 680 | 1e−47 | 100 |
| 946 | 405 | 700574515H1 | SATMON030 | g514945 | BLASTN | 369 | 1e−46 | 74 |
| 947 | 405 | 700155148H1 | SATMON007 | g514945 | BLASTN | 397 | 1e−45 | 97 |
| 948 | 405 | 700612388H1 | SATMON033 | g514945 | BLASTN | 625 | 1e−43 | 100 |
| 949 | 405 | 700474681H1 | SATMON025 | g22485 | BLASTN | 379 | 1e−41 | 91 |
| 950 | 405 | 700800401H1 | SATMON036 | g22485 | BLASTN | 395 | 1e−40 | 90 |
| 951 | 405 | 700155657H1 | SATMON007 | g514945 | BLASTN | 591 | 1e−40 | 95 |
| 952 | 405 | 700076002H1 | SATMON007 | g514945 | BLASTN | 575 | 1e−39 | 100 |
| 953 | 405 | 700802090H1 | SATMON036 | g22485 | BLASTN | 577 | 1e−39 | 98 |
| 954 | 405 | 700170104H1 | SATMON013 | g22485 | BLASTN | 565 | 1e−38 | 100 |
| 955 | 405 | 701183763H1 | SATMONN06 | g514945 | BLASTN | 569 | 1e−38 | 90 |
| 956 | 405 | 700084688H1 | SATMON011 | g514945 | BLASTN | 380 | 1e−36 | 98 |
| 957 | 405 | 700473655H1 | SATMON025 | g22485 | BLASTN | 530 | 1e−35 | 100 |
| 958 | 405 | 700615166H1 | SATMON033 | g514945 | BLASTN | 531 | 1e−35 | 94 |
| 959 | 405 | 700085562H1 | SATMON011 | g533251 | BLASTN | 532 | 1e−35 | 98 |

TABLE A*-continued

| Seq No. | Cluster ID | CloneID | Library | NCBI gi | Method | Score | P-value | % Ident |
|---|---|---|---|---|---|---|---|---|
| 960 | 405 | 700153049H1 | SATMON007 | g514945 | BLASTN | 537 | 1e−35 | 94 |
| 961 | 405 | 700090656H1 | SATMON011 | g514945 | BLASTN | 489 | 1e−34 | 98 |
| 962 | 405 | 700802054H1 | SATMON036 | g22485 | BLASTN | 345 | 1e−31 | 99 |
| 963 | 405 | 700802284H1 | SATMON036 | g22485 | BLASTN | 488 | 1e−31 | 97 |
| 964 | 405 | 700802312H1 | SATMON036 | g22485 | BLASTN | 270 | 1e−30 | 100 |
| 965 | 405 | 700153683H1 | SATMON007 | g22485 | BLASTN | 461 | 1e−29 | 98 |
| 966 | 405 | 700028453H1 | SATMON003 | g22485 | BLASTN | 321 | 1e−27 | 99 |
| 967 | 405 | 700089391H1 | SATMON011 | g514945 | BLASTN | 404 | 1e−24 | 96 |
| 968 | 405 | 700381969H1 | SATMON023 | g22485 | BLASTN | 385 | 1e−23 | 94 |
| 969 | 405 | 700800135H1 | SATMON036 | g22485 | BLASTN | 180 | 1e−21 | 100 |
| 970 | 405 | 700088173H1 | SATMON011 | g514945 | BLASTN | 347 | 1e−20 | 95 |
| 971 | 405 | 700202170H1 | SATMON003 | g19108 | BLASTX | 133 | 1e−11 | 96 |
| 972 | 537 | 700209929H1 | SATMON016 | g22485 | BLASTN | 1478 | 1e−114 | 99 |
| 973 | 537 | 700096948H1 | SATMON008 | g22485 | BLASTN | 911 | 1e−113 | 99 |
| 974 | 537 | 700476287H1 | SATMON025 | g22485 | BLASTN | 1403 | 1e−108 | 98 |
| 975 | 537 | 700803088H1 | SATMON036 | g22485 | BLASTN | 1336 | 1e−107 | 96 |
| 976 | 537 | 700799436H1 | SATMON036 | g22485 | BLASTN | 1361 | 1e−104 | 99 |
| 977 | 537 | 700224822H1 | SATMON011 | g22485 | BLASTN | 1300 | 1e−103 | 96 |
| 978 | 537 | 700241134H1 | SATMON010 | g22485 | BLASTN | 1302 | 1e−99 | 99 |
| 979 | 537 | 700803625H1 | SATMON036 | g22485 | BLASTN | 1292 | 1e−98 | 99 |
| 980 | 537 | 700802549H1 | SATMON036 | g22485 | BLASTN | 1232 | 1e−93 | 99 |
| 981 | 537 | 700477992H1 | SATMON025 | g22485 | BLASTN | 943 | 1e−92 | 97 |
| 982 | 537 | 700150953H1 | SATMON007 | g22485 | BLASTN | 1152 | 1e−87 | 99 |
| 983 | 537 | 700205638H1 | SATMON003 | g22485 | BLASTN | 1086 | 1e−81 | 99 |
| 984 | 537 | 700803732H1 | SATMON036 | g22487 | BLASTN | 379 | 1e−79 | 97 |
| 985 | 537 | 700165461H1 | SATMON013 | g22485 | BLASTN | 1064 | 1e−79 | 98 |
| 986 | 537 | 700807069H1 | SATMON036 | g22485 | BLASTN | 957 | 1e−77 | 96 |
| 987 | 537 | 700800902H1 | SATMON036 | g22485 | BLASTN | 762 | 1e−54 | 86 |
| 988 | 537 | 700466671H1 | SATMON025 | g22485 | BLASTN | 520 | 1e−44 | 95 |
| 989 | 537 | 700799118H1 | SATMON036 | g22485 | BLASTN | 626 | 1e−43 | 99 |
| 990 | 537 | 700802273H1 | SATMON036 | g22485 | BLASTN | 616 | 1e−42 | 99 |
| 991 | 537 | 700804848H1 | SATMON036 | g22485 | BLASTN | 306 | 1e−33 | 98 |
| 992 | 8549 | 700103190H1 | SATMON010 | g1100216 | BLASTN | 615 | 1e−92 | 98 |
| 993 | 8549 | 700075574H1 | SATMON007 | g1100216 | BLASTN | 701 | 1e−92 | 100 |
| 994 | 8549 | 700218547H1 | SATMON011 | g514945 | BLASTN | 1208 | 1e−91 | 99 |
| 995 | 8549 | 700213873H1 | SATMON016 | g1100216 | BLASTN | 673 | 1e−90 | 95 |
| 996 | 8549 | 700221147H1 | SATMON011 | g1100216 | BLASTN | 646 | 1e−89 | 98 |
| 997 | 8549 | 700207093H1 | SATMON003 | g1100216 | BLASTN | 701 | 1e−87 | 100 |
| 998 | 8549 | 700210112H1 | SATMON016 | g1100216 | BLASTN | 615 | 1e−84 | 98 |
| 999 | 8549 | 700096984H1 | SATMON008 | g514945 | BLASTN | 1111 | 1e−83 | 99 |
| 1000 | 8549 | 700221070H1 | SATMON011 | g1100216 | BLASTN | 645 | 1e−82 | 96 |
| 1001 | 8549 | 700332046H1 | SATMON019 | g1100216 | BLASTN | 601 | 1e−76 | 89 |
| 1002 | 8549 | 700150377H1 | SATMON007 | g1100216 | BLASTN | 621 | 1e−74 | 100 |
| 1003 | 8549 | 700084780H1 | SATMON011 | g514945 | BLASTN | 585 | 1e−39 | 100 |
| 1004 | 8549 | 700153082H1 | SATMON007 | g1100216 | BLASTN | 495 | 1e−36 | 89 |
| 1005 | 8549 | 700261144H1 | SATMON017 | g1100216 | BLASTN | 339 | 1e−35 | 87 |
| 1006 | 8549 | 700264112H1 | SATMON017 | g1100216 | BLASTN | 428 | 1e−34 | 91 |
| 1007 | 8549 | 700473660H1 | SATMON025 | g1100216 | BLASTN | 415 | 1e−28 | 100 |
| 1008 | 8549 | 700473628H1 | SATMON025 | g514945 | BLASTN | 329 | 1e−26 | 88 |
| 1009 | 8549 | 700351060H1 | SATMON023 | g1100216 | BLASTN | 291 | 1e−22 | 91 |
| 1010 | −L30595280 | LIB3059-039-Q1-K1-A5 | LIB3059 | g22485 | BLASTN | 473 | 1e−30 | 79 |
| 1011 | −L30612133 | LIB3061-024-Q1-K1-H5 | LIB3061 | g22485 | BLASTN | 849 | 1e−61 | 80 |
| 1012 | −L30616296 | LIB3061-043-Q1-K1-A10 | LIB3061 | g22485 | BLASTN | 479 | 1e−98 | 82 |
| 1013 | −L30623037 | LIB3062-030-Q1-K1-F12 | LIB3062 | g514945 | BLASTN | 684 | 1e−48 | 78 |
| 1014 | −L30625289 | LIB3062-021-Q1-K1-C2 | LIB3062 | g514945 | BLASTN | 1180 | 1e−111 | 79 |
| 1015 | −L30663565 | LIB3066-053-Q1-K1-D6 | LIB3066 | g530978 | BLASTN | 568 | 1e−36 | 76 |
| 1016 | −L30784420 | LIB3078-039-Q1-K1-A4 | LIB3078 | g514945 | BLASTN | 484 | 1e−40 | 81 |
| 1017 | 30444 | LIB3069-052-Q1-K1-F8 | LIB3069 | g1100216 | BLASTN | 558 | 1e−77 | 89 |
| 1018 | 32909 | LIB143-057-Q1-E1-F6 | LIB143 | g2570066 | BLASTN | 902 | 1e−69 | 74 |
| 1019 | 405 | LIB3062-021-Q1-K1-C5 | LIB3062 | g514945 | BLASTN | 2368 | 1e−188 | 99 |
| 1020 | 405 | LIB3078-024-Q1-KI-C5 | LIB3078 | g514945 | BLASTN | 2356 | 1e−187 | 98 |
| 1021 | 405 | LIB3059-028-Q1-KI-D5 | LIB3059 | g22485 | BLASTN | 2163 | 1e−171 | 98 |
| 1022 | 405 | LIB3059-015-Q1-K1-E7 | LIB3059 | g22485 | BLASTN | 2167 | 1e−171 | 98 |

TABLE A*-continued

| Seq No. | Cluster ID | CloneID | Library | NCBI gi | Method | Score | P-value | % Ident |
|---|---|---|---|---|---|---|---|---|
| 1023 | 405 | LIB3059-044-Q1-K1-E7 | LIB3059 | g514945 | BLASTN | 2170 | 1e-171 | 98 |
| 1024 | 405 | LIB3061-029-Q1-K1-G11 | LIB3061 | g22485 | BLASTN | 2055 | 1e-170 | 98 |
| 1025 | 405 | LIB3059-011-Q1-K1-F5 | LIB3059 | g22485 | BLASTN | 2137 | 1e-169 | 98 |
| 1026 | 405 | LIB3062-009-Q1-K1-D1 | LIB3062 | g514945 | BLASTN | 2122 | 1e-167 | 98 |
| 1027 | 405 | LIB3061-011-Q1-K1-D9 | LIB3061 | g22485 | BLASTN | 2091 | 1e-165 | 98 |
| 1028 | 405 | LIB3067-040-Q1-K1-E8 | LIB3067 | g514945 | BLASTN | 1916 | 1e-164 | 99 |
| 1029 | 405 | LIB3062-041-Q1-K1-D4 | LIB3062 | g514945 | BLASTN | 2082 | 1e-164 | 97 |
| 1030 | 405 | LIB3062-022-Q1-K1-C9 | LIB3062 | g514945 | BLASTN | 2084 | 1e-164 | 99 |
| 1031 | 405 | LIB3062-033-Q1-KI-C7 | LIB3062 | g514945 | BLASTN | 1854 | 1e-161 | 95 |
| 1032 | 405 | LIB3062-002-Q1-K2-F9 | LIB3062 | g514945 | BLASTN | 1854 | 1e-161 | 97 |
| 1033 | 405 | LIB3059-010-Q1-K1-C9 | LIB3059 | g22485 | BLASTN | 2018 | 1e-159 | 99 |
| 1034 | 405 | LIB3059-013-Q1-K1-B10 | LIB3059 | g22485 | BLASTN | 2022 | 1e-159 | 98 |
| 1035 | 405 | LIB3061-020-Q1-K1-F2 | LIB3061 | g22485 | BLASTN | 1771 | 1e-158 | 97 |
| 1036 | 405 | LIB3061-022-Q1-K1-C2 | LIB3061 | g22485 | BLASTN | 1909 | 1e-158 | 98 |
| 1037 | 405 | LIB3062-023-Q1-K1-D10 | LIB3062 | g22485 | BLASTN | 1508 | 1e-157 | 96 |
| 1038 | 405 | LIB3061-008-Q1-K1-H11 | LIB3061 | g22485 | BLASTN | 1983 | 1e-156 | 97 |
| 1039 | 405 | LIB3059-024-Q1-K1-H4 | LIB3059 | g22485 | BLASTN | 1051 | 1e-154 | 99 |
| 1040 | 405 | LIB3062-048-Q1-K1-G5 | LIB3062 | g22485 | BLASTN | 1187 | 1e-154 | 94 |
| 1041 | 405 | LIB3061-025-Q1-K1-B1 | LIB3061 | g22485 | BLASTN | 1803 | 1e-154 | 95 |
| 1042 | 405 | LIB3061-028-Q1-K1-C4 | LIB3061 | g22485 | BLASTN | 1963 | 1e-154 | 97 |
| 1043 | 405 | LIB3078-057-Q1-K1-D9 | LIB3078 | g514945 | BLASTN | 1412 | 1e-153 | 92 |
| 1044 | 405 | LIB3061-021-Q1-K1-A8 | LIB3061 | g22485 | BLASTN | 1465 | 1e-153 | 96 |
| 1045 | 405 | LIB3061-025-Q1-K1-B5 | LIB3061 | g22485 | BLASTN | 1524 | 1e-153 | 96 |
| 1046 | 405 | LIB3061-008-Q1-K1-C7 | LIB3061 | g22485 | BLASTN | 1879 | 1e-153 | 94 |
| 1047 | 405 | LIB3078-039-Q1-K1-A8 | LIB3078 | g514945 | BLASTN | 1853 | 1e-151 | 96 |
| 1048 | 405 | LIB3061-049-Q1-K1-E5 | LIB3061 | g22485 | BLASTN | 1801 | 1e-150 | 98 |
| 1049 | 405 | LIB3062-001-Q1-K2-G2 | LIB3062 | g514945 | BLASTN | 1916 | 1e-150 | 94 |
| 1050 | 405 | LIB3061-021-Q1-K1-G6 | LIB3061 | g22485 | BLASTN | 1918 | 1e-150 | 92 |
| 1051 | 405 | LIB3061-039-Q1-K1-D2 | LIB3061 | g22485 | BLASTN | 1361 | 1e-149 | 96 |
| 1052 | 405 | LIB3061-051-Q1-K1-G8 | LIB3061 | g22485 | BLASTN | 1768 | 1e-148 | 98 |
| 1053 | 405 | LIB3061-015-Q1-K1-A12 | LIB3061 | g22485 | BLASTN | 1667 | 1e-146 | 93 |
| 1054 | 405 | LIB3059-040-Q1-K1-H11 | LIB3059 | g22485 | BLASTN | 1835 | 1e-146 | 97 |
| 1055 | 405 | LIB3061-002-Q1-K2-G5 | LIB3061 | g22485 | BLASTN | 1845 | 1e-144 | 89 |
| 1056 | 405 | LIB3062-002-Q1-K2-G12 | LIB3062 | g22485 | BLASTN | 1672 | 1e-142 | 99 |
| 1057 | 405 | LIB3059-048-Q1-K1-H5 | LIB3059 | g22485 | BLASTN | 1822 | 1e-142 | 99 |
| 1058 | 405 | LIB3078-040-Q1-K1-F8 | LIB3078 | g514945 | BLASTN | 1801 | 1e-141 | 97 |
| 1059 | 405 | LIB3078-001-Q1-K1-C7 | LIB3078 | g22485 | BLASTN | 1246 | 1e-139 | 95 |
| 1060 | 405 | LIB3061-024-Q1-K1-A12 | LIB3061 | g22485 | BLASTN | 1376 | 1e-139 | 94 |

TABLE A*-continued

| Seq No. | Cluster ID | CloneID | Library | NCBI gi | Method | Score | P-value | % Ident |
|---|---|---|---|---|---|---|---|---|
| 1061 | 405 | LIB3061-026-Q1-K1-D3 | LIB3061 | g22485 | BLASTN | 1643 | 1e−138 | 93 |
| 1062 | 405 | LIB3061-056-Q1-K1-D8 | LIB3061 | g22485 | BLASTN | 1763 | 1e−138 | 92 |
| 1063 | 405 | LIB3069-041-Q1-K1-G12 | LIB3069 | g514945 | BLASTN | 1758 | 1e−137 | 97 |
| 1064 | 405 | LIB3059-025-Q1-K1-E5 | LIB3059 | g22485 | BLASTN | 1532 | 1e−132 | 94 |
| 1065 | 405 | LIB3061-014-Q1-K1-D4 | LIB3061 | g22485 | BLASTN | 1294 | 1e−130 | 88 |
| 1066 | 405 | LIB3061-005-Q1-K1-C9 | LIB3061 | g22485 | BLASTN | 1540 | 1e−130 | 97 |
| 1067 | 405 | LIB3061-016-Q1-K1-G2 | LIB3061 | g22485 | BLASTN | 1251 | 1e−129 | 85 |
| 1068 | 405 | LIB3069-029-Q1-K1-B2 | LIB3069 | g514945 | BLASTN | 1657 | 1e−129 | 88 |
| 1069 | 405 | LIB3078-012-Q1-K1-F7 | LIB3078 | g514945 | BLASTN | 857 | 1e−128 | 86 |
| 1070 | 405 | LIB3078-016-Q1-K1-D7 | LIB3078 | g514945 | BLASTN | 1335 | 1e−128 | 87 |
| 1071 | 405 | LIB3062-049-Q1-K1-A8 | LIB3062 | g514945 | BLASTN | 1609 | 1e−128 | 88 |
| 1072 | 405 | LIB143-006-Q1-E1-G12 | LIB143 | g514945 | BLASTN | 1614 | 1e−125 | 96 |
| 1073 | 405 | LIB3059-024-Q1-K1-E5 | LIB3059 | g22485 | BLASTN | 1529 | 1e−123 | 83 |
| 1074 | 405 | LIB3069-008-Q1-K1-C1 | LIB3069 | g514945 | BLASTN | 1036 | 1e−115 | 94 |
| 1075 | 405 | LIB3059-018-Q1-K1-F11 | LIB3059 | g514945 | BLASTN | 910 | 1e−103 | 93 |
| 1076 | 405 | LIB3078-001-Q1-K1-E8 | LIB3078 | g514945 | BLASTN | 952 | 1e−98 | 90 |
| 1077 | 405 | LIB3059-017-Q1-K1-G4 | LIB3059 | g22485 | BLASTN | 1170 | 1e−88 | 92 |
| 1078 | 405 | LIB3067-045-Q1-K1-E9 | LIB3067 | g533251 | BLASTN | 917 | 1e−87 | 87 |
| 1079 | 405 | LIB3062-015-Q1-K1-C1 | LIB3062 | g514945 | BLASTN | 1066 | 1e−86 | 96 |
| 1080 | 405 | LIB3059-039-Q1-K1-A3 | LIB3059 | g22485 | BLASTN | 856 | 1e−82 | 92 |
| 1081 | 405 | LIB3062-024-Q1-K1-C3 | LIB3062 | g514945 | BLASTN | 548 | 1e−79 | 88 |
| 1082 | 405 | LIB3059-029-Q1-K1-F1 | LIB3059 | g22485 | BLASTN | 925 | 1e−74 | 94 |
| 1083 | 405 | LIB3059-006-Q1-K1-F4 | LIB3059 | g22485 | BLASTN | 530 | 1e−50 | 83 |
| 1084 | 405 | LIB3067-017-Q1-K1-C3 | LIB3067 | g533251 | BLASTN | 425 | 1e−26 | 100 |
| 1085 | 405 | LIB3061-028-Q1-K1-A9 | LIB3061 | g19106 | BLASTX | 118 | 1e−25 | 100 |
| 1086 | 537 | LIB3066-009-Q1-K1-B9 | LIB3066 | g22485 | BLASTN | 1369 | 1e−122 | 96 |
| MAIZE HEXOKINASE | | | | | | | | |
| 1087 | −700018381 | 700018381H1 | SATMON001 | g1899025 | BLASTX | 166 | 1e−16 | 48 |
| 1088 | −700051079 | 700051079H1 | SATMON003 | g1899025 | BLASTX | 84 | 1e−11 | 50 |
| 1089 | −700101579 | 700101579H1 | SATMON009 | g881521 | BLASTX | 217 | 1e−23 | 66 |
| 1090 | −700105594 | 700105594H1 | SATMON010 | g3087888 | BLASTX | 181 | 1e−17 | 57 |
| 1091 | −700106018 | 700106018H1 | SATMON010 | g3087888 | BLASTX | 195 | 1e−19 | 64 |
| 1092 | −700157233 | 700157233H1 | SATMON012 | g3087888 | BLASTX | 198 | 1e−20 | 58 |
| 1093 | −700202992 | 700202992H1 | SATMON003 | g3087888 | BLASTX | 89 | 1e−9 | 58 |
| 1094 | −700224204 | 700224204H1 | SATMON011 | g1899024 | BLASTN | 520 | 1e−34 | 70 |
| 1095 | −700241273 | 700241273H1 | SATMON010 | g3087888 | BLASTX | 184 | 1e−18 | 58 |
| 1096 | −700352183 | 700352183H1 | SATMON023 | g1899024 | BLASTN | 481 | 1e−31 | 70 |
| 1097 | −700573814 | 700573814H1 | SATMON030 | g1899024 | BLASTN | 535 | 1e−34 | 67 |
| 1098 | −700612458 | 700612458H1 | SATMON033 | g619928 | BLASTX | 229 | 1e−26 | 61 |
| 1099 | −701168774 | 701168774H1 | SATMONN05 | g619927 | BLASTN | 252 | 1e−10 | 62 |
| 1100 | 1195 | 700457430H1 | SATMON029 | g3087888 | BLASTX | 122 | 1e−19 | 53 |
| 1101 | 13262 | 700102942H1 | SATMON010 | g3087888 | BLASTX | 113 | 1e−18 | 53 |
| 1102 | 1378 | 700456148H1 | SATMON029 | g1899025 | BLASTX | 267 | 1e−29 | 59 |
| 1103 | 1378 | 700455837H1 | SATMON029 | g1899025 | BLASTX | 166 | 1e−21 | 60 |
| 1104 | 17305 | 700460742H1 | SATMON031 | g619928 | BLASTX | 131 | 1e−15 | 57 |
| 1105 | 17305 | 700614972H1 | SATMON033 | g1899025 | BLASTX | 100 | 1e−8 | 53 |
| 1106 | 1842 | 700089135H1 | SATMON011 | g619928 | BLASTX | 405 | 1e−49 | 70 |
| 1107 | 1842 | 700430234H1 | SATMONN01 | g619927 | BLASTN | 461 | 1e−28 | 72 |
| 1108 | 1842 | 700166122H1 | SATMON013 | g619928 | BLASTX | 183 | 1e−18 | 84 |
| 1109 | 24376 | 700053677H1 | SATMON010 | g1899024 | BLASTN | 642 | 1e−44 | 70 |

TABLE A*-continued

| Seq No. | Cluster ID | CloneID | Library | NCBI gi | Method | Score | P-value | % Ident |
|---|---|---|---|---|---|---|---|---|
| 1110 | 24376 | 700152328H1 | SATMON007 | g619927 | BLASTN | 555 | 1e-37 | 69 |
| 1111 | 24376 | 700623451H1 | SATMON034 | g619928 | BLASTN | 197 | 1e-32 | 72 |
| 1112 | 28388 | 700089065H1 | SATMON011 | g619928 | BLASTX | 186 | 1e-30 | 61 |
| 1113 | 3345 | 700072110H1 | SATMON007 | g619928 | BLASTX | 125 | 1e-24 | 66 |
| 1114 | 3345 | 700472061H1 | SATMON025 | g619928 | BLASTX | 112 | 1e-20 | 55 |
| 1115 | 3345 | 701173753H1 | SATMONN05 | g619928 | BLASTX | 135 | 1e-16 | 54 |
| 1116 | 3345 | 700202130H1 | SATMON003 | g619928 | BLASTX | 113 | 1e-11 | 68 |
| 1117 | 5073 | 700582054H1 | SATMON031 | g619928 | BLASTX | 247 | 1e-29 | 66 |
| 1118 | 5073 | 700053432H1 | SATMON009 | g619928 | BLASTX | 233 | 1e-25 | 60 |
| 1119 | 6731 | 700099009H1 | SATMON009 | g619927 | BLASTN | 736 | 1e-52 | 72 |
| 1120 | 6731 | 700089738H1 | SATMON011 | g1899024 | BLASTN | 700 | 1e-49 | 70 |
| 1121 | 6731 | 700171542H1 | SATMON013 | g619927 | BLASTN | 530 | 1e-35 | 74 |
| 1122 | 7565 | 700356773H1 | SATMON024 | g1899025 | BLASTX | 177 | 1e-17 | 62 |
| 1123 | 9695 | 700212172H1 | SATMON016 | g1899024 | BLASTN | 832 | 1e-60 | 74 |
| 1124 | 9695 | 700212124H1 | SATMON016 | g1899024 | BLASTN | 835 | 1e-60 | 75 |
| 1125 | 9695 | 700094278H1 | SATMON008 | g1899024 | BLASTN | 819 | 1e-59 | 74 |
| 1126 | -L30621307 | LIB3062-001-Q1-K2-G11 | LIB3062 | g1899025 | BLASTX | 95 | 1e-32 | 53 |
| 1127 | -L30782665 | LIB3078-007-Q1-K1-E9 | LIB3078 | g3087888 | BLASTX | 130 | 1e-39 | 47 |
| 1128 | 24376 | LIB3069-041-Q1-K1-E7 | LIB3069 | g1899024 | BLASTN | 608 | 1e-61 | 70 |
| 1129 | 28244 | LIB3061-004-Q1-K1-F9 | LIB3061 | g687676 | BLASTN | 499 | 1e-30 | 65 |
| 1130 | 28388 | LIB3066-030-Q1-K1-G10 | LIB3066 | g619928 | BLASTX | 299 | 1e-63 | 64 |
| 1131 | 3364 | LIB3078-051-Q1-K1-B3 | LIB3078 | g687676 | BLASTN | 619 | 1e-41 | 67 |
| 1132 | 3364 | LIB3078-053-Q1-K1-C9 | LIB3078 | g687676 | BLASTN | 627 | 1e-41 | 69 |
| 1133 | 3364 | LIB84-015-Q1-E1-F7 | LIB84 | g687676 | BLASTN | 554 | 1e-35 | 69 |
| 1134 | 6731 | LIB3061-028-Q1-K1-C1 | LIB3061 | g1899024 | BLASTN | 831 | 1e-60 | 70 |
| 1135 | 9695 | LIB143-065-Q1-E1-C10 | LIB143 | g1899024 | BLASTN | 1096 | 1e-82 | 73 |
| | | MAIZE FRUCTOKINASE | | | | | | |
| 1136 | -700106058 | 700106058H1 | SATMON010 | g1052972 | BLASTN | 220 | 1e-9 | 68 |
| 1137 | -700151135 | 700151135H1 | SATMON007 | g297014 | BLASTN | 351 | 1e-18 | 75 |
| 1138 | -700169310 | 700169310H1 | SATMON013 | g1052972 | BLASTN | 273 | 1e-12 | 59 |
| 1139 | -700210226 | 700210226H1 | SATMON016 | g1052973 | BLASTX | 188 | 1e-24 | 68 |
| 1140 | -700257901 | 700257901H1 | SATMON017 | g297015 | BLASTX | 200 | 1e-20 | 72 |
| 1141 | -700621274 | 700621274H1 | SATMON034 | g1052973 | BLASTX | 141 | 1e-24 | 64 |
| 1142 | 11678 | 700105513H1 | SATMON010 | g1052972 | BLASTN | 580 | 1e-39 | 64 |
| 1143 | 11678 | 700170725H1 | SATMON013 | g1052972 | BLASTN | 478 | 1e-31 | 66 |
| 1144 | 2526 | 700159958H1 | SATMON012 | g1052973 | BLASTX | 152 | 1e-14 | 64 |
| 1145 | 2754 | 700102678H1 | SATMON010 | g1052972 | BLASTN | 707 | 1e-50 | 69 |
| 1146 | 2754 | 700102312H1 | SATMON010 | g1052972 | BLASTN | 701 | 1e-49 | 69 |
| 1147 | 2754 | 700205695H1 | SATMON003 | g1915973 | BLASTN | 633 | 1e-43 | 69 |
| 1148 | 2754 | 700221511H1 | SATMON011 | g1915973 | BLASTN | 587 | 1e-40 | 69 |
| 1149 | 2754 | 700469079H1 | SATMON025 | g1052972 | BLASTN | 584 | 1e-39 | 72 |
| 1150 | 2754 | 701173520H1 | SATMONN05 | g1915973 | BLASTN | 342 | 1e-36 | 70 |
| 1151 | 2754 | 700267332H1 | SATMON017 | g1052972 | BLASTN | 541 | 1e-35 | 64 |
| 1152 | 2754 | 701164907H1 | SATMONN04 | g1052973 | BLASTX | 280 | 1e-33 | 57 |
| 1153 | 2754 | 700450050H2 | SATMON028 | g1052973 | BLASTX | 160 | 1e-31 | 60 |
| 1154 | 2754 | 701182860H1 | SATMONN06 | g297015 | BLASTX | 188 | 1e-27 | 65 |
| 1155 | 2754 | 700467520H1 | SATMON025 | g1915974 | BLASTX | 242 | 1e-26 | 60 |
| 1156 | 2754 | 700159848H1 | SATMON012 | g1052973 | BLASTX | 197 | 1e-24 | 63 |
| 1157 | 3287 | 700088103H1 | SATMON011 | g2102693 | BLASTX | 239 | 1e-43 | 74 |
| 1158 | 3287 | 700210913H1 | SATMON016 | g2102693 | BLASTX | 250 | 1e-35 | 77 |
| 1159 | 3287 | 700167609H1 | SATMON013 | g1052973 | BLASTX | 300 | 1e-35 | 68 |
| 1160 | 3287 | 700085916H1 | SATMON011 | g1052972 | BLASTN | 553 | 1e-35 | 64 |
| 1161 | 3287 | 700262715H1 | SATMON017 | g1915974 | BLASTX | 201 | 1e-33 | 71 |
| 1162 | 3287 | 700170179H1 | SATMON013 | g1052973 | BLASTX | 289 | 1e-33 | 67 |
| 1163 | 3287 | 700615671H1 | SATMON033 | g1052972 | BLASTN | 515 | 1e-32 | 63 |
| 1164 | 3287 | 700223640H1 | SATMON011 | g1052973 | BLASTX | 219 | 1e-31 | 67 |
| 1165 | 3287 | 700215234H1 | SATMON016 | g1052973 | BLASTX | 190 | 1e-30 | 67 |
| 1166 | 3287 | 700203946H1 | SATMON003 | g1052973 | BLASTX | 198 | 1e-30 | 60 |
| 1167 | 3287 | 700028411H1 | SATMON003 | g2102693 | BLASTX | 110 | 1e-29 | 57 |
| 1168 | 3287 | 700224307H1 | SATMON011 | g1052973 | BLASTX | 159 | 1e-29 | 87 |
| 1169 | 3287 | 700072013H1 | SATMON007 | g1052973 | BLASTX | 191 | 1e-29 | 65 |
| 1170 | 3287 | 700215669H1 | SATMON016 | g1052973 | BLASTX | 260 | 1e-29 | 57 |
| 1171 | 3287 | 700353954H1 | SATMON024 | g1052973 | BLASTX | 260 | 1e-29 | 61 |
| 1172 | 3287 | 700342211H1 | SATMON021 | g1052973 | BLASTX | 137 | 1e-28 | 67 |
| 1173 | 3287 | 700085462H1 | SATMON011 | g297014 | BLASTN | 466 | 1e-28 | 62 |
| 1174 | 3287 | 700220972H1 | SATMON011 | g1052973 | BLASTX | 109 | 1e-27 | 83 |

TABLE A*-continued

| Seq No. | Cluster ID | CloneID | Library | NCBI gi | Method | Score | P-value | % Ident |
|---|---|---|---|---|---|---|---|---|
| 1175 | 3287 | 700451141H1 | SATMON028 | g1052973 | BLASTX | 245 | 1e−27 | 63 |
| 1176 | 3287 | 700087484H1 | SATMON011 | g1052972 | BLASTN | 440 | 1e−26 | 64 |
| 1177 | 3287 | 700343411H1 | SATMON021 | g1052973 | BLASTX | 163 | 1e−25 | 67 |
| 1178 | 3287 | 700217263H1 | SATMON016 | g1915973 | BLASTN | 393 | 1e−25 | 68 |
| 1179 | 3287 | 700030665H1 | SATMON003 | g1052973 | BLASTX | 176 | 1e−24 | 71 |
| 1180 | 3287 | 700343380H1 | SATMON021 | g1052973 | BLASTX | 228 | 1e−24 | 57 |
| 1181 | 3287 | 701159743H2 | SATMONN04 | g1052973 | BLASTX | 183 | 1e−23 | 55 |
| 1182 | 3287 | 700221543H1 | SATMON011 | g1052973 | BLASTX | 217 | 1e−23 | 50 |
| 1183 | 3287 | 700333946H1 | SATMON019 | g1052973 | BLASTX | 178 | 1e−22 | 66 |
| 1184 | 3287 | 700091730H1 | SATMON011 | g1052973 | BLASTX | 171 | 1e−21 | 64 |
| 1185 | 3287 | 700570521H1 | SATMON030 | g1915974 | BLASTX | 98 | 1e−18 | 58 |
| 1186 | 3287 | 700048604H1 | SATMON003 | g1052973 | BLASTX | 88 | 1e−15 | 54 |
| 1187 | 3287 | 700208681H1 | SATMON016 | g1052973 | BLASTX | 129 | 1e−15 | 55 |
| 1188 | 3287 | 700028328H1 | SATMON003 | g1052973 | BLASTX | 162 | 1e−15 | 66 |
| 1189 | 3287 | 700220530H1 | SATMON011 | g1052973 | BLASTX | 141 | 1e−14 | 88 |
| 1190 | 3287 | 700243726H1 | SATMON010 | g1052973 | BLASTX | 153 | 1e−14 | 68 |
| 1191 | 3287 | 700142502H1 | SATMON012 | g1052973 | BLASTX | 157 | 1e−14 | 47 |
| 1192 | 3287 | 700336537H1 | SATMON019 | g1052973 | BLASTX | 141 | 1e−12 | 50 |
| 1193 | 3287 | 700205308H1 | SATMON003 | g1052973 | BLASTX | 133 | 1e−11 | 75 |
| 1194 | 5966 | 700084171H1 | SATMON011 | g1052972 | BLASTN | 448 | 1e−26 | 66 |
| 1195 | 5966 | 700084951H1 | SATMON011 | g2102693 | BLASTX | 214 | 1e−22 | 73 |
| 1196 | 5966 | 700089353H1 | SATMON011 | g2102691 | BLASTX | 195 | 1e−20 | 72 |
| 1197 | 5966 | 700220723H1 | SATMON011 | g1915974 | BLASTX | 198 | 1e−20 | 73 |
| 1198 | 5966 | 700084412H1 | SATMON011 | g2102693 | BLASTX | 179 | 1e−19 | 76 |
| 1199 | 5966 | 700085628H1 | SATMON011 | g2102691 | BLASTX | 180 | 1e−18 | 72 |
| 1200 | 5966 | 700027982H1 | SATMON003 | g2102691 | BLASTX | 178 | 1e−17 | 72 |
| 1201 | 5966 | 700106884H1 | SATMON010 | g1915974 | BLASTX | 148 | 1e−13 | 75 |
| 1202 | 5966 | 700053135H1 | SATMON008 | g1915974 | BLASTX | 131 | 1e−11 | 73 |
| 1203 | 5966 | 700027988H1 | SATMON003 | g1915974 | BLASTX | 134 | 1e−11 | 65 |
| 1204 | 5966 | 700207083H1 | SATMON003 | g1915974 | BLASTX | 100 | 1e−10 | 46 |
| 1205 | 5966 | 700158574H1 | SATMON012 | g1915974 | BLASTX | 120 | 1e−9 | 50 |
| 1206 | 2754 | LIB3061-030-Q1-K1-G12 | LIB3061 | g1052972 | BLASTN | 882 | 1e−64 | 67 |
| 1207 | 2754 | LIB3061-030-Q1-K1-G11 | LIB3061 | g1052972 | BLASTN | 751 | 1e−52 | 68 |
| 1208 | 3287 | LIB3067-040-Q1-K1-H10 | LIB3067 | g1052972 | BLASTN | 657 | 1e−44 | 64 |
| 1209 | 3287 | LIB84-024-Q1-E1-H7 | LIB84 | g1052972 | BLASTN | 638 | 1e−42 | 64 |
| 1210 | 3287 | LIB3069-045-Q1-K1-F6 | LIB3069 | g1052972 | BLASTN | 592 | 1e−38 | 61 |
| 1211 | 3287 | LIB3061-014-Q1-K1-A3 | LIB3061 | g1052973 | BLASTX | 175 | 1e−36 | 41 |
| 1212 | 3287 | LIB3062-019-Q1-K1-H11 | LIB3062 | g1052973 | BLASTX | 154 | 1e−30 | 68 |
| 1213 | 3287 | LIB3067-054-Q1-K1-C9 | LIB3067 | g1052972 | BLASTN | 495 | 1e−30 | 61 |
| 1214 | 3287 | LIB3067-022-Q1-K1-H4 | LIB3067 | g1052973 | BLASTX | 141 | 1e−27 | 68 |
| 1215 | 3287 | LIB3069-045-Q1-K1-F2 | LIB3069 | g1052972 | BLASTN | 439 | 1e−25 | 57 |
| | | MAIZE NDP-KINASE | | | | | | |
| 1216 | −700575072 | 700575072H1 | SATMON030 | g303849 | BLASTX | 74 | 1e−13 | 89 |
| 1217 | −701170773 | 701170773H1 | SATMONN05 | g1777930 | BLASTX | 132 | 1e−30 | 71 |
| 1218 | 2462 | 700050003H1 | SATMON003 | g218233 | BLASTN | 656 | 1e−58 | 83 |
| 1219 | 2462 | 700204789H1 | SATMON003 | g218233 | BLASTN | 780 | 1e−58 | 87 |
| 1220 | 2462 | 700049819H1 | SATMON003 | g218233 | BLASTN | 786 | 1e−58 | 86 |
| 1221 | 2462 | 700204211H1 | SATMON003 | g218233 | BLASTN | 786 | 1e−58 | 86 |
| 1222 | 2462 | 700205742H1 | SATMON003 | g218233 | BLASTN | 763 | 1e−57 | 86 |
| 1223 | 2462 | 700207611H1 | SATMON016 | g218233 | BLASTN | 764 | 1e−57 | 87 |
| 1224 | 2462 | 700072505H1 | SATMON007 | g218233 | BLASTN | 740 | 1e−55 | 86 |
| 1225 | 2462 | 700236468H1 | SATMON010 | g218233 | BLASTN | 710 | 1e−52 | 86 |
| 1226 | 2462 | 701181270H1 | SATMONN06 | g218233 | BLASTN | 445 | 1e−51 | 86 |
| 1227 | 2462 | 700573201H1 | SATMON030 | g218233 | BLASTN | 691 | 1e−51 | 81 |
| 1228 | 2462 | 700452623H1 | SATMON028 | g218233 | BLASTN | 694 | 1e−51 | 85 |
| 1229 | 2462 | 700351523H1 | SATMON023 | g218233 | BLASTN | 679 | 1e−50 | 86 |
| 1230 | 2462 | 700042795H1 | SATMON004 | g218233 | BLASTN | 630 | 1e−45 | 86 |
| 1231 | 2462 | 700445979H1 | SATMON027 | g218233 | BLASTN | 595 | 1e−43 | 86 |
| 1232 | 2462 | 700201855H1 | SATMON003 | g218233 | BLASTN | 604 | 1e−43 | 87 |
| 1233 | 2462 | 700573101H1 | SATMON030 | g218233 | BLASTN | 594 | 1e−42 | 78 |
| 1234 | 2462 | 700049543H1 | SATMON003 | g218233 | BLASTN | 577 | 1e−41 | 79 |
| 1235 | 2462 | 700432359H1 | SATMONN01 | g218233 | BLASTN | 561 | 1e−40 | 81 |
| 1236 | 2462 | 701182021H1 | SATMONN06 | g218233 | BLASTN | 561 | 1e−40 | 85 |
| 1237 | 2462 | 701182019H1 | SATMONN06 | g218233 | BLASTN | 566 | 1e−40 | 86 |
| 1238 | 2462 | 700150928H1 | SATMON007 | g218233 | BLASTN | 569 | 1e−40 | 85 |
| 1239 | 2462 | 700202824H1 | SATMON003 | g218233 | BLASTN | 336 | 1e−39 | 86 |

TABLE A*-continued

| Seq No. | Cluster ID | CloneID | Library | NCBI gi | Method | Score | P-value | % Ident |
|---|---|---|---|---|---|---|---|---|
| 1240 | 2462 | 700451056H1 | SATMON028 | g218233 | BLASTN | 553 | 1e−39 | 85 |
| 1241 | 2462 | 700449958H1 | SATMON028 | g218233 | BLASTN | 544 | 1e−38 | 86 |
| 1242 | 2462 | 700347592H1 | SATMON023 | g218233 | BLASTN | 403 | 1e−34 | 78 |
| 1243 | 2462 | 700573195H1 | SATMON030 | g218233 | BLASTN | 200 | 1e−22 | 84 |
| 1244 | 2462 | 700582836H1 | SATMON031 | g303849 | BLASTX | 157 | 1e−15 | 83 |
| 1245 | 2462 | 700029459H1 | SATMON003 | g303849 | BLASTX | 134 | 1e−11 | 84 |
| 1246 | 27065 | 700583429H1 | SATMON031 | g1064895 | BLASTX | 72 | 1e−13 | 54 |
| 1247 | −L1482546 | LIB148-007-Q1-E1-E6 | LIB148 | g218233 | BLASTN | 359 | 1e−19 | 75 |
| 1248 | 2462 | LIB3067-039-Q1-K1-B10 | LIB3067 | g218233 | BLASTN | 711 | 1e−52 | 82 |
| 1249 | 2462 | LIB3078-001-Q1-K1-F3 | LIB3078 | g218233 | BLASTN | 488 | 1e−49 | 85 |
| 1250 | 2462 | LIB3067-029-Q1-K1-C3 | LIB3067 | g1236951 | BLASTX | 166 | 1e−31 | 96 |
| 1251 | 25174 | LIB189-022-Q1-E1-E9 | LIB189 | g758643 | BLASTN | 440 | 1e−25 | 76 |
| MAIZE GLUCOSE-6-PHOSPHATE 1-DEHYDROGENASE | | | | | | | | |
| 1252 | −700047645 | 700047645H1 | SATMON003 | g471345 | BLASTX | 193 | 1e−21 | 58 |
| 1253 | −700210379 | 700210379H1 | SATMON016 | g1480344 | BLASTX | 103 | 1e−10 | 85 |
| 1254 | 9135 | 700203121H1 | SATMON003 | g1166405 | BLASTX | 108 | 1e−10 | 78 |
| MAIZE PHOSPHOGLUCOMUTASE | | | | | | | | |
| 1255 | −700045655 | 700045655H1 | SATMON004 | g534982 | BLASTX | 144 | 1e−12 | 65 |
| 1256 | −700053330 | 700053330H1 | SATMON009 | g3294467 | BLASTX | 211 | 1e−23 | 71 |
| 1257 | −700102193 | 700102193H1 | SATMON010 | g534982 | BLASTX | 145 | 1e−14 | 53 |
| 1258 | −700166982 | 700166982H1 | SATMON013 | g2795876 | BLASTX | 168 | 1e−16 | 52 |
| 1259 | −700169540 | 700169540H1 | SATMON013 | g534982 | BLASTX | 180 | 1e−17 | 61 |
| 1260 | −700210088 | 700210088H1 | SATMON016 | g534982 | BLASTX | 328 | 1e−38 | 55 |
| 1261 | −700573194 | 700573194H1 | SATMON030 | g534982 | BLASTX | 192 | 1e−21 | 54 |
| 1262 | −700616588 | 700616588H1 | SATMON033 | g3294468 | BLASTN | 593 | 1e−48 | 95 |
| 1263 | 119 | 700574655H1 | SATMON030 | g3294466 | BLASTN | 1705 | 1e−133 | 98 |
| 1264 | 119 | 700574672H1 | SATMON030 | g3294466 | BLASTN | 820 | 1e−121 | 100 |
| 1265 | 119 | 700100992H1 | SATMON009 | g3294466 | BLASTN | 1545 | 1e−119 | 99 |
| 1266 | 119 | 700615409H1 | SATMON033 | g3294466 | BLASTN | 1050 | 1e−118 | 100 |
| 1267 | 119 | 700210693H1 | SATMON016 | g3294468 | BLASTN | 1515 | 1e−117 | 100 |
| 1268 | 119 | 700381526H1 | SATMON023 | g3294468 | BLASTN | 1490 | 1e−115 | 100 |
| 1269 | 119 | 700026372H1 | SATMON003 | g3294466 | BLASTN | 1463 | 1e−113 | 99 |
| 1270 | 119 | 700201578H1 | SATMON003 | g3294468 | BLASTN | 677 | 1e−112 | 96 |
| 1271 | 119 | 700101083H1 | SATMON009 | g3294468 | BLASTN | 1430 | 1e−110 | 100 |
| 1272 | 119 | 700217101H1 | SATMON016 | g3294468 | BLASTN | 1420 | 1e−109 | 100 |
| 1273 | 119 | 700222466H1 | SATMON011 | g3294466 | BLASTN | 957 | 1e−106 | 97 |
| 1274 | 119 | 700072492H1 | SATMON007 | g3294466 | BLASTN | 1381 | 1e−106 | 99 |
| 1275 | 119 | 700043724H1 | SATMON004 | g3294468 | BLASTN | 1390 | 1e−106 | 100 |
| 1276 | 119 | 700346762H1 | SATMON021 | g3294468 | BLASTN | 1333 | 1e−102 | 94 |
| 1277 | 119 | 700347741H1 | SATMON023 | g3294468 | BLASTN | 1339 | 1e−102 | 97 |
| 1278 | 119 | 700550792H1 | SATMON022 | g3294466 | BLASTN | 731 | 1e−101 | 99 |
| 1279 | 119 | 700380144H1 | SATMON021 | g3294466 | BLASTN | 1216 | 1e−98 | 97 |
| 1280 | 119 | 700241526H1 | SATMON010 | g3294466 | BLASTN | 1285 | 1e−98 | 100 |
| 1281 | 119 | 700380456H1 | SATMON021 | g3294468 | BLASTN | 650 | 1e−97 | 99 |
| 1282 | 119 | 700238734H1 | SATMON010 | g3294466 | BLASTN | 974 | 1e−97 | 97 |
| 1283 | 119 | 700083634H1 | SATMON011 | g3294468 | BLASTN | 1265 | 1e−96 | 100 |
| 1284 | 119 | 700383086H1 | SATMON024 | g3294466 | BLASTN | 961 | 1e−94 | 96 |
| 1285 | 119 | 700169630H1 | SATMON013 | g3294466 | BLASTN | 1245 | 1e−94 | 100 |
| 1286 | 119 | 701177766H1 | SATMONN05 | g3294466 | BLASTN | 1187 | 1e−93 | 97 |
| 1287 | 119 | 700142461H1 | SATMON012 | g3294466 | BLASTN | 1231 | 1e−93 | 99 |
| 1288 | 119 | 700044235H1 | SATMON004 | g3294466 | BLASTN | 1175 | 1e−89 | 100 |
| 1289 | 119 | 700216921H1 | SATMON016 | g3294466 | BLASTN | 1165 | 1e−88 | 100 |
| 1290 | 119 | 700333779H1 | SATMON019 | g3294466 | BLASTN | 996 | 1e−87 | 96 |
| 1291 | 119 | 700021881H1 | SATMON001 | g3294468 | BLASTN | 1120 | 1e−84 | 100 |
| 1292 | 119 | 700049194H1 | SATMON003 | g3294468 | BLASTN | 940 | 1e−82 | 98 |
| 1293 | 119 | 700164477H1 | SATMON013 | g3294466 | BLASTN | 1091 | 1e−82 | 99 |
| 1294 | 119 | 700169514H1 | SATMON013 | g3294468 | BLASTN | 865 | 1e−80 | 100 |
| 1295 | 119 | 700050896H1 | SATMON003 | g3294466 | BLASTN | 591 | 1e−76 | 94 |
| 1296 | 119 | 700172394H1 | SATMON013 | g3294466 | BLASTN | 1024 | 1e−76 | 99 |
| 1297 | 119 | 700211437H1 | SATMON016 | g3294468 | BLASTN | 994 | 1e−73 | 99 |
| 1298 | 119 | 700084535H1 | SATMON011 | g3294466 | BLASTN | 973 | 1e−72 | 99 |
| 1299 | 119 | 700203439H1 | SATMON003 | g3294466 | BLASTN | 765 | 1e−71 | 100 |
| 1300 | 119 | 700257833H1 | SATMON017 | g3294468 | BLASTN | 611 | 1e−69 | 94 |
| 1301 | 119 | 700621831H1 | SATMON034 | g3294466 | BLASTN | 412 | 1e−52 | 90 |
| 1302 | 119 | 700354511H1 | SATMON024 | g3294468 | BLASTN | 703 | 1e−52 | 91 |
| 1303 | 119 | 700203525H1 | SATMON003 | g3294468 | BLASTN | 708 | 1e−50 | 99 |
| 1304 | 119 | 700020476H1 | SATMON001 | g3294468 | BLASTN | 658 | 1e−45 | 99 |
| 1305 | 119 | 700050562H1 | SATMON003 | g3294466 | BLASTN | 544 | 1e−42 | 88 |
| 1306 | 119 | 700613868H1 | SATMON033 | g3294466 | BLASTN | 615 | 1e−42 | 100 |
| 1307 | 119 | 700574982H1 | SATMON030 | g3294466 | BLASTN | 473 | 1e−35 | 97 |

TABLE A*-continued

| Seq No. | Cluster ID | CloneID | Library | NCBI gi | Method | Score | P-value | % Ident |
|---|---|---|---|---|---|---|---|---|
| 1308 | 119 | 700049512H1 | SATMON003 | g3294466 | BLASTN | 268 | 1e−29 | 95 |
| 1309 | 119 | 700260372H2 | SATMON017 | g3294466 | BLASTN | 226 | 1e−10 | 89 |
| 1310 | 16726 | 700082801H1 | SATMON011 | g2829893 | BLASTN | 278 | 1e−30 | 55 |
| 1311 | 16726 | 700212054H1 | SATMON016 | g2829893 | BLASTX | 220 | 1e−23 | 53 |
| 1312 | 19462 | 700097450H1 | SATMON009 | g1814400 | BLASTN | 323 | 1e−29 | 64 |
| 1313 | 19462 | 700441165H1 | SATMON026 | g1408296 | BLASTX | 239 | 1e−25 | 61 |
| 1314 | 24348 | 700379424H1 | SATMON020 | g3294466 | BLASTN | 707 | 1e−50 | 98 |
| 1315 | 2587 | 700089556H1 | SATMON011 | g2829893 | BLASTX | 117 | 1e−8 | 67 |
| 1316 | 3016 | 700204345H1 | SATMON003 | g3294468 | BLASTN | 1784 | 1e−139 | 98 |
| 1317 | 3016 | 700098713H1 | SATMON009 | g3294468 | BLASTN | 1516 | 1e−117 | 99 |
| 1318 | 3016 | 700084751H1 | SATMON011 | g3294466 | BLASTN | 1475 | 1e−114 | 100 |
| 1319 | 3016 | 700351326H1 | SATMON023 | g3294468 | BLASTN | 1460 | 1e−112 | 100 |
| 1320 | 3016 | 700097161H1 | SATMON009 | g3294466 | BLASTN | 1308 | 1e−109 | 98 |
| 1321 | 3016 | 700266423H1 | SATMON017 | g3294466 | BLASTN | 1065 | 1e−108 | 96 |
| 1322 | 3016 | 700349605H1 | SATMON023 | g3294466 | BLASTN | 1335 | 1e−107 | 100 |
| 1323 | 3016 | 700350209H1 | SATMON023 | g3294468 | BLASTN | 1188 | 1e−106 | 97 |
| 1324 | 3016 | 700265291H1 | SATMON017 | g3294468 | BLASTN | 873 | 1e−100 | 98 |
| 1325 | 3016 | 700457572H1 | SATMON029 | g3294466 | BLASTN | 1288 | 1e−98 | 98 |
| 1326 | 3016 | 700334810H1 | SATMON019 | g3294468 | BLASTN | 863 | 1e−97 | 99 |
| 1327 | 3016 | 700194444H1 | SATMON014 | g3294466 | BLASTN | 1265 | 1e−96 | 100 |
| 1328 | 3016 | 700457426H1 | SATMON029 | g3294466 | BLASTN | 1236 | 1e−94 | 98 |
| 1329 | 3016 | 700210958H1 | SATMON016 | g3294466 | BLASTN | 1148 | 1e−92 | 98 |
| 1330 | 3016 | 700075135H1 | SATMON007 | g3294468 | BLASTN | 1219 | 1e−92 | 97 |
| 1331 | 3016 | 700152065H1 | SATMON007 | g3294466 | BLASTN | 1135 | 1e−90 | 99 |
| 1332 | 3016 | 700219672H1 | SATMON011 | g3294468 | BLASTN | 823 | 1e−89 | 99 |
| 1333 | 3016 | 700170425H1 | SATMON013 | g3294466 | BLASTN | 1110 | 1e−83 | 100 |
| 1334 | 3016 | 700153495H1 | SATMON007 | g3294468 | BLASTN | 640 | 1e−82 | 100 |
| 1335 | 3016 | 700348567H1 | SATMON023 | g3294468 | BLASTN | 557 | 1e−81 | 87 |
| 1336 | 3016 | 700803158H1 | SATMON036 | g3294468 | BLASTN | 630 | 1e−60 | 85 |
| 1337 | 3016 | 700264923H1 | SATMON017 | g3294468 | BLASTN | 340 | 1e−50 | 98 |
| 1338 | 3016 | 700615715H1 | SATMON033 | g3294466 | BLASTN | 567 | 1e−48 | 96 |
| 1339 | 3016 | 700027830H1 | SATMON003 | g3294468 | BLASTN | 632 | 1e−43 | 95 |
| 1340 | 3016 | 700350539H1 | SATMON023 | g3294466 | BLASTN | 333 | 1e−41 | 96 |
| 1341 | 4562 | 700044891H1 | SATMON004 | g3294466 | BLASTN | 650 | 1e−45 | 74 |
| 1342 | 4562 | 700215538H1 | SATMON016 | g3294466 | BLASTN | 555 | 1e−37 | 67 |
| 1343 | 9894 | 700220429H1 | SATMON011 | g3294468 | BLASTN | 1302 | 1e−99 | 99 |
| 1344 | 9894 | 700236461H1 | SATMON010 | g3294466 | BLASTN | 1054 | 1e−90 | 97 |
| 1345 | −L30594453 | LIB3059-042-Q1-K1-B5 | LIB3059 | g1814401 | BLASTX | 290 | 1e−49 | 58 |
| 1346 | −L30605287 | LIB3060-049-Q1-K1-B7 | LIB3060 | g534982 | BLASTX | 172 | 1e−34 | 77 |
| 1347 | 119 | LIB3059-019-Q1-K1-H1 | LIB3059 | g1881692 | BLASTN | 2094 | 1e−165 | 98 |
| 1348 | 119 | LIB3059-031-Q1-K1-H10 | LIB3059 | g1881692 | BLASTN | 1926 | 1e−151 | 96 |
| 1349 | 119 | LIB3069-012-Q1-K1-F2 | LIB3069 | g1881692 | BLASTN | 1188 | 1e−146 | 90 |
| 1350 | 119 | LIB36-019-Q1-E1-A7 | LIB36 | g1881692 | BLASTN | 1783 | 1e−139 | 90 |
| 1351 | 119 | LIB3078-023-Q1-K1-C3 | LIB3078 | g1881692 | BLASTN | 860 | 1e−124 | 87 |
| 1352 | 119 | LIB3067-058-Q1-K1-G1 | LIB3067 | g1881692 | BLASTN | 991 | 1e−114 | 99 |
| 1353 | 119 | LIB3062-048-Q1-K1-B7 | LIB3062 | g1881692 | BLASTN | 1181 | 1e−103 | 97 |
| 1354 | 119 | LIB3069-023-Q1-K1-G4 | LIB3069 | g1881692 | BLASTN | 1176 | 1e−87 | 84 |
| 1355 | 119 | LIB3069-025-Q1-K1-B6 | LIB3069 | g1881692 | BLASTN | 611 | 1e−65 | 91 |
| 1356 | 24348 | LIB3066-043-Q1-K1-F11 | LIB3066 | g1881692 | BLASTN | 560 | 1e−37 | 100 |
| 1357 | 24348 | LIB3067-048-Q1-K1-F3 | LIB3067 | g1881692 | BLASTN | 543 | 1e−36 | 99 |
| 1358 | 3016 | LIB143-002-Q1-E1-C12 | LIB143 | g2829893 | BLASTX | 224 | 1e−51 | 72 |
| 1359 | 3016 | LIB189-034-Q1-E1-A11 | LIB189 | g2829893 | BLASTX | 216 | 1e−48 | 68 |
| 1360 | 3016 | LIB3069-043-Q1-K1-D5 | LIB3069 | g1814401 | BLASTX | 98 | 1e−32 | 64 |
| MAIZE UDP-GLUCOSE PYROPHOSPHORYLASE | | | | | | | | |
| 1361 | −700197315 | 700197315H1 | SATMON014 | g1388021 | BLASTX | 122 | 1e−9 | 70 |
| 1362 | −700203530 | 700203530H1 | SATMON003 | g1212995 | BLASTN | 568 | 1e−38 | 78 |
| 1363 | −700267284 | 700267284H1 | SATMON017 | g1212996 | BLASTX | 150 | 1e−13 | 87 |
| 1364 | −700336683 | 700336683H1 | SATMON019 | g1752677 | BLASTX | 150 | 1e−27 | 82 |
| 1365 | −700342324 | 700342324H1 | SATMON021 | g3107931 | BLASTX | 95 | 1e−14 | 80 |
| 1366 | −700354856 | 700354856H1 | SATMON024 | g1388021 | BLASTX | 121 | 1e−22 | 75 |

TABLE A*-continued

| Seq No. | Cluster ID | CloneID | Library | NCBI gi | Method | Score | P-value | % Ident |
|---|---|---|---|---|---|---|---|---|
| 1367 | −700613858 | 700613858H1 | SATMON033 | g1212995 | BLASTN | 776 | 1e−59 | 88 |
| 1368 | 14982 | 700028996H1 | SATMON003 | g1212995 | BLASTN | 560 | 1e−37 | 76 |
| 1369 | 14982 | 700155115H1 | SATMON007 | g1212995 | BLASTN | 399 | 1e−31 | 81 |
| 1370 | 14982 | 700356747H1 | SATMON024 | g1388021 | BLASTX | 166 | 1e−15 | 76 |
| 1371 | 19537 | 700573761H1 | SATMON030 | g1212995 | BLASTN | 954 | 1e−70 | 79 |
| 1372 | 19537 | 700208049H1 | SATMON016 | g1212995 | BLASTN | 901 | 1e−66 | 78 |
| 1373 | 19537 | 700086382H1 | SATMON011 | g1212995 | BLASTN | 885 | 1e−64 | 77 |
| 1374 | 69 | 700091881H1 | SATMON011 | g1212995 | BLASTN | 844 | 1e−105 | 89 |
| 1375 | 69 | 700624406H1 | SATMON034 | g1212995 | BLASTN | 816 | 1e−97 | 88 |
| 1376 | 69 | 700211464H1 | SATMON016 | g1212995 | BLASTN | 1251 | 1e−95 | 88 |
| 1377 | 69 | 700099836H1 | SATMON009 | g1212995 | BLASTN | 1239 | 1e−94 | 88 |
| 1378 | 69 | 700084756H1 | SATMON011 | g1212995 | BLASTN | 1240 | 1e−94 | 90 |
| 1379 | 69 | 700076136H1 | SATMON007 | g1212995 | BLASTN | 1243 | 1e−94 | 89 |
| 1380 | 69 | 700073071H1 | SATMON007 | g1212995 | BLASTN | 1163 | 1e−88 | 86 |
| 1381 | 69 | 700614228H1 | SATMON033 | g1212995 | BLASTN | 1013 | 1e−87 | 84 |
| 1382 | 69 | 700379926H1 | SATMON021 | g1212995 | BLASTN | 1138 | 1e−86 | 88 |
| 1383 | 69 | 700089172H1 | SATMON011 | g1212995 | BLASTN | 1141 | 1e−86 | 88 |
| 1384 | 69 | 700265063H1 | SATMON017 | g1212995 | BLASTN | 1147 | 1e−86 | 86 |
| 1385 | 69 | 700085964H1 | SATMON011 | g1212995 | BLASTN | 1135 | 1e−85 | 85 |
| 1386 | 69 | 700282281H2 | SATMON023 | g1212995 | BLASTN | 1136 | 1e−85 | 86 |
| 1387 | 69 | 700429855H1 | SATMONN01 | g1212995 | BLASTN | 1114 | 1e−84 | 89 |
| 1388 | 69 | 700347453H1 | SATMON023 | g1212995 | BLASTN | 1117 | 1e−84 | 87 |
| 1389 | 69 | 700265087H1 | SATMON017 | g1212995 | BLASTN | 1120 | 1e−84 | 87 |
| 1390 | 69 | 700092705H1 | SATMON008 | g1212995 | BLASTN | 1122 | 1e−84 | 87 |
| 1391 | 69 | 700212686H1 | SATMON016 | g1212995 | BLASTN | 1123 | 1e−84 | 91 |
| 1392 | 69 | 700623332H1 | SATMON034 | g1212995 | BLASTN | 800 | 1e−83 | 86 |
| 1393 | 69 | 700041787H1 | SATMON004 | g1212995 | BLASTN | 1091 | 1e−82 | 91 |
| 1394 | 69 | 700219031H1 | SATMON011 | g1212995 | BLASTN | 1093 | 1e−82 | 89 |
| 1395 | 69 | 700218632H1 | SATMON011 | g1212995 | BLASTN | 1086 | 1e−81 | 90 |
| 1396 | 69 | 700211962H1 | SATMON016 | g1212995 | BLASTN | 1086 | 1e−81 | 86 |
| 1397 | 69 | 700220729H1 | SATMON011 | g1212995 | BLASTN | 916 | 1e−80 | 84 |
| 1398 | 69 | 700197025H1 | SATMON014 | g1212995 | BLASTN | 1063 | 1e−79 | 89 |
| 1399 | 69 | 700086546H1 | SATMON011 | g1212995 | BLASTN | 1049 | 1e−78 | 86 |
| 1400 | 69 | 700217064H1 | SATMON016 | g1212995 | BLASTN | 1051 | 1e−78 | 88 |
| 1401 | 69 | 700799128H1 | SATMON036 | g1212995 | BLASTN | 618 | 1e−77 | 88 |
| 1402 | 69 | 700265488H1 | SATMON017 | g1212995 | BLASTN | 1030 | 1e−77 | 84 |
| 1403 | 69 | 700043842H1 | SATMON004 | g1212995 | BLASTN | 1035 | 1e−77 | 87 |
| 1404 | 69 | 700236833H1 | SATMON010 | g1212995 | BLASTN | 1035 | 1e−77 | 87 |
| 1405 | 69 | 700219083H1 | SATMON011 | g1212995 | BLASTN | 1036 | 1e−77 | 88 |
| 1406 | 69 | 700042338H1 | SATMON004 | g1212995 | BLASTN | 1037 | 1e−77 | 87 |
| 1407 | 69 | 700352484H1 | SATMON023 | g1212995 | BLASTN | 1038 | 1e−77 | 85 |
| 1408 | 69 | 700083771H1 | SATMON011 | g1212995 | BLASTN | 613 | 1e−76 | 91 |
| 1409 | 69 | 700473855H1 | SATMON025 | g1212995 | BLASTN | 755 | 1e−76 | 85 |
| 1410 | 69 | 700353922H1 | SATMON024 | g1212995 | BLASTN | 1024 | 1e−76 | 85 |
| 1411 | 69 | 700023267H1 | SATMON003 | g1212995 | BLASTN | 1007 | 1e−75 | 89 |
| 1412 | 69 | 700157596H1 | SATMON012 | g1212995 | BLASTN | 1008 | 1e−75 | 87 |
| 1413 | 69 | 700218718H1 | SATMON011 | g1212995 | BLASTN | 1012 | 1e−75 | 86 |
| 1414 | 69 | 700162316H1 | SATMON012 | g1212995 | BLASTN | 626 | 1e−74 | 80 |
| 1415 | 69 | 700046475H1 | SATMON004 | g1212995 | BLASTN | 1003 | 1e−74 | 85 |
| 1416 | 69 | 700466010H1 | SATMON025 | g1212995 | BLASTN | 558 | 1e−73 | 82 |
| 1417 | 69 | 700571392H1 | SATMON030 | g1212995 | BLASTN | 985 | 1e−73 | 85 |
| 1418 | 69 | 700165241H1 | SATMON013 | g1212995 | BLASTN | 987 | 1e−73 | 85 |
| 1419 | 69 | 700457410H1 | SATMON029 | g1212995 | BLASTN | 988 | 1e−73 | 87 |
| 1420 | 69 | 700194672H1 | SATMON014 | g1212995 | BLASTN | 963 | 1e−71 | 86 |
| 1421 | 69 | 700089746H1 | SATMON011 | g1212995 | BLASTN | 964 | 1e−71 | 83 |
| 1422 | 69 | 700801620H1 | SATMON036 | g1212995 | BLASTN | 536 | 1e−70 | 91 |
| 1423 | 69 | 700264785H1 | SATMON017 | g1212995 | BLASTN | 952 | 1e−70 | 84 |
| 1424 | 69 | 700244093H1 | SATMON010 | g1212995 | BLASTN | 954 | 1e−70 | 85 |
| 1425 | 69 | 700043787H1 | SATMON004 | g1212995 | BLASTN | 957 | 1e−70 | 85 |
| 1426 | 69 | 700267269H1 | SATMON017 | g1212995 | BLASTN | 867 | 1e−69 | 85 |
| 1427 | 69 | 700167985H1 | SATMON013 | g1212995 | BLASTN | 940 | 1e−69 | 89 |
| 1428 | 69 | 700799042H1 | SATMON036 | g1212995 | BLASTN | 812 | 1e−68 | 89 |
| 1429 | 69 | 700163824H1 | SATMON013 | g1212995 | BLASTN | 888 | 1e−65 | 86 |
| 1430 | 69 | 700098307H1 | SATMON009 | g1212995 | BLASTN | 461 | 1e−63 | 81 |
| 1431 | 69 | 700805267H1 | SATMON036 | g1212995 | BLASTN | 734 | 1e−63 | 88 |
| 1432 | 69 | 700204843H1 | SATMON003 | g1212995 | BLASTN | 854 | 1e−62 | 88 |
| 1433 | 69 | 700206721H1 | SATMON003 | g1212995 | BLASTN | 461 | 1e−61 | 81 |
| 1434 | 69 | 700018559H1 | SATMON001 | g1212995 | BLASTN | 847 | 1e−61 | 85 |
| 1435 | 69 | 700026241H1 | SATMON003 | g1212995 | BLASTN | 847 | 1e−61 | 87 |
| 1436 | 69 | 700099987H1 | SATMON009 | g1212995 | BLASTN | 461 | 1e−60 | 81 |
| 1437 | 69 | 700475628H1 | SATMON025 | g1212995 | BLASTN | 750 | 1e−59 | 80 |
| 1438 | 69 | 700016675H1 | SATMON001 | g1212995 | BLASTN | 814 | 1e−59 | 86 |
| 1439 | 69 | 700150144H1 | SATMON007 | g1212995 | BLASTN | 822 | 1e−59 | 86 |
| 1440 | 69 | 700267260H1 | SATMON017 | g1212995 | BLASTN | 461 | 1e−58 | 80 |
| 1441 | 69 | 700261336H1 | SATMON017 | g1212995 | BLASTN | 564 | 1e−58 | 82 |
| 1442 | 69 | 700618652H1 | SATMON033 | g1212995 | BLASTN | 730 | 1e−58 | 78 |
| 1443 | 69 | 700469914H1 | SATMON025 | g1212995 | BLASTN | 735 | 1e−58 | 89 |

TABLE A*-continued

| Seq No. | Cluster ID | CloneID | Library | NCBI gi | Method | Score | P-value | % Ident |
|---|---|---|---|---|---|---|---|---|
| 1444 | 69 | 700048027H1 | SATMON003 | g1212995 | BLASTN | 807 | 1e−58 | 83 |
| 1445 | 69 | 700165703H1 | SATMON013 | g1212995 | BLASTN | 796 | 1e−57 | 85 |
| 1446 | 69 | 700265403H1 | SATMON017 | g1212995 | BLASTN | 797 | 1e−57 | 78 |
| 1447 | 69 | 700099428H1 | SATMON009 | g1212995 | BLASTN | 474 | 1e−56 | 88 |
| 1448 | 69 | 700243212H1 | SATMON010 | g1212995 | BLASTN | 779 | 1e−56 | 84 |
| 1449 | 69 | 700092996H1 | SATMON008 | g1212995 | BLASTN | 789 | 1e−56 | 84 |
| 1450 | 69 | 700803035H1 | SATMON036 | g1212995 | BLASTN | 436 | 1e−54 | 80 |
| 1451 | 69 | 700235803H1 | SATMON010 | g1212995 | BLASTN | 688 | 1e−54 | 79 |
| 1452 | 69 | 700172581H1 | SATMON013 | g1212995 | BLASTN | 754 | 1e−54 | 79 |
| 1453 | 69 | 700214715H1 | SATMON016 | g1212995 | BLASTN | 762 | 1e−54 | 86 |
| 1454 | 69 | 700223082H1 | SATMON011 | g1212995 | BLASTN | 764 | 1e−54 | 84 |
| 1455 | 69 | 700093483H1 | SATMON008 | g1212995 | BLASTN | 357 | 1e−51 | 88 |
| 1456 | 69 | 700261920H1 | SATMON017 | g1212995 | BLASTN | 363 | 1e−51 | 82 |
| 1457 | 69 | 700221718H1 | SATMON011 | g1212995 | BLASTN | 363 | 1e−51 | 83 |
| 1458 | 69 | 700453106H1 | SATMON028 | g1212995 | BLASTN | 670 | 1e−51 | 82 |
| 1459 | 69 | 700210506H1 | SATMON016 | g1212995 | BLASTN | 461 | 1e−50 | 85 |
| 1460 | 69 | 700212333H1 | SATMON016 | g1212995 | BLASTN | 443 | 1e−49 | 83 |
| 1461 | 69 | 700072654H1 | SATMON007 | g1212995 | BLASTN | 443 | 1e−49 | 79 |
| 1462 | 69 | 700218282H1 | SATMON016 | g1212995 | BLASTN | 452 | 1e−49 | 85 |
| 1463 | 69 | 700263725H1 | SATMON017 | g1212995 | BLASTN | 662 | 1e−49 | 80 |
| 1464 | 69 | 700343083H1 | SATMON021 | g1212995 | BLASTN | 388 | 1e−48 | 80 |
| 1465 | 69 | 700219739H1 | SATMON011 | g1212995 | BLASTN | 443 | 1e−48 | 81 |
| 1466 | 69 | 700620336H1 | SATMON034 | g1212995 | BLASTN | 621 | 1e−48 | 88 |
| 1467 | 69 | 700264630H1 | SATMON017 | g1212995 | BLASTN | 377 | 1e−47 | 80 |
| 1468 | 69 | 700439242H1 | SATMON026 | g1212995 | BLASTN | 648 | 1e−47 | 83 |
| 1469 | 69 | 700259658H1 | SATMON017 | g1212995 | BLASTN | 511 | 1e−45 | 79 |
| 1470 | 69 | 700263521H1 | SATMON017 | g1212995 | BLASTN | 461 | 1e−44 | 79 |
| 1471 | 69 | 700261387H1 | SATMON017 | g1212995 | BLASTN | 461 | 1e−44 | 80 |
| 1472 | 69 | 700439277H1 | SATMON026 | g1212995 | BLASTN | 461 | 1e−43 | 84 |
| 1473 | 69 | 700452839H1 | SATMON028 | g1212995 | BLASTN | 544 | 1e−43 | 77 |
| 1474 | 69 | 700220236H1 | SATMON011 | g1212995 | BLASTN | 448 | 1e−40 | 84 |
| 1475 | 69 | 700472602H1 | SATMON025 | g1212995 | BLASTN | 254 | 1e−38 | 81 |
| 1476 | 69 | 700266424H1 | SATMON017 | g1212995 | BLASTN | 499 | 1e−37 | 80 |
| 1477 | 69 | 700449187H1 | SATMON028 | g1212995 | BLASTN | 540 | 1e−36 | 81 |
| 1478 | 69 | 700202731H1 | SATMON003 | g1212995 | BLASTN | 543 | 1e−36 | 79 |
| 1479 | 69 | 700156144H2 | SATMON007 | g1212995 | BLASTN | 441 | 1e−35 | 76 |
| 1480 | 69 | 700442679H1 | SATMON026 | g1212995 | BLASTN | 533 | 1e−35 | 80 |
| 1481 | 69 | 700449879H2 | SATMON028 | g1212995 | BLASTN | 535 | 1e−35 | 81 |
| 1482 | 69 | 700266832H1 | SATMON017 | g1212995 | BLASTN | 346 | 1e−34 | 77 |
| 1483 | 69 | 700332389H1 | SATMON019 | g1212995 | BLASTN | 382 | 1e−34 | 84 |
| 1484 | 69 | 700804202H1 | SATMON036 | g1212995 | BLASTN | 436 | 1e−34 | 76 |
| 1485 | 69 | 700151037H1 | SATMON007 | g1212995 | BLASTN | 443 | 1e−34 | 79 |
| 1486 | 69 | 700802810H1 | SATMON036 | g1212995 | BLASTN | 525 | 1e−34 | 85 |
| 1487 | 69 | 700455879H1 | SATMON029 | g1212995 | BLASTN | 448 | 1e−32 | 72 |
| 1488 | 69 | 700427769H1 | SATMONN01 | g1212995 | BLASTN | 481 | 1e−31 | 81 |
| 1489 | 69 | 700464626H1 | SATMON025 | g1212995 | BLASTN | 388 | 1e−30 | 76 |
| 1490 | 69 | 700439228H1 | SATMON026 | g1212995 | BLASTN | 470 | 1e−30 | 77 |
| 1491 | 69 | 700256847H1 | SATMON017 | g1212995 | BLASTN | 264 | 1e−29 | 85 |
| 1492 | 69 | 700204881H1 | SATMON003 | g1212995 | BLASTN | 430 | 1e−29 | 81 |
| 1493 | 69 | 700076032H1 | SATMON007 | g1212995 | BLASTN | 218 | 1e−26 | 72 |
| 1494 | 69 | 700426342H1 | SATMONN01 | g1212995 | BLASTN | 443 | 1e−26 | 79 |
| 1495 | 69 | 700209062H1 | SATMON016 | g1212995 | BLASTN | 279 | 1e−24 | 80 |
| 1496 | 69 | 700076988H1 | SATMON007 | g1212995 | BLASTN | 337 | 1e−24 | 83 |
| 1497 | 69 | 700349778H1 | SATMON023 | g1212995 | BLASTN | 406 | 1e−24 | 81 |
| 1498 | 69 | 700261886H1 | SATMON017 | g1212995 | BLASTN | 287 | 1e−15 | 80 |
| 1499 | 69 | 700426642H1 | SATMONN01 | g1388021 | BLASTX | 161 | 1e−14 | 76 |
| 1500 | 69 | 700155195H1 | SATMON007 | g1212995 | BLASTN | 155 | 1e−10 | 81 |
| 1501 | 69 | 700211992H1 | SATMON016 | g1212996 | BLASTX | 118 | 1e−9 | 85 |
| 1502 | −L1485255 | LIB148-053-Q1-E1-E12 | LIB148 | g1212995 | BLASTN | 691 | 1e−48 | 80 |
| 1503 | −L30663959 | LIB3066-015-Q1-K1-F12 | LIB3066 | g218000 | BLASTN | 251 | 1e−9 | 65 |
| 1504 | 19537 | LIB3066-025-Q1-K1-E5 | LIB3066 | g1212995 | BLASTN | 1001 | 1e−74 | 79 |
| 1505 | 69 | LIB3059-023-Q1-K1-C8 | LIB3059 | g1212995 | BLASTN | 1301 | 1e−133 | 89 |
| 1506 | 69 | LIB3078-022-Q1-K1-C1 | LIB3078 | g1212995 | BLASTN | 1656 | 1e−129 | 86 |
| 1507 | 69 | LIB3059-037-Q1-K1-H5 | LIB3059 | g1212995 | BLASTN | 1646 | 1e−128 | 86 |
| 1508 | 69 | LIB3061-030-Q1-K1-A12 | LIB3061 | g1212995 | BLASTN | 1493 | 1e−124 | 86 |
| 1509 | 69 | LIB3061-023-Q1-K1-A1 | LIB3061 | g1212995 | BLASTN | 1598 | 1e−124 | 86 |
| 1510 | 69 | LIB3079-001-Q1-K1-D12 | LIB3079 | g1212995 | BLASTN | 1600 | 1e−124 | 83 |

TABLE A*-continued

| Seq No. | Cluster ID | CloneID | Library | NCBI gi | Method | Score | P-value | % Ident |
|---|---|---|---|---|---|---|---|---|
| 1511 | 69 | LIB189-028-Q1-E1-E3 | LIB189 | g1212995 | BLASTN | 1583 | 1e-123 | 87 |
| 1512 | 69 | LIB3067-017-Q1-K1-D9 | LIB3067 | g1212995 | BLASTN | 1364 | 1e-120 | 88 |
| 1513 | 69 | LIB3068-007-Q1-K1-F9 | LIB3068 | g1212995 | BLASTN | 1501 | 1e-116 | 85 |
| 1514 | 69 | LIB3069-025-Q1-K1-E9 | LIB3069 | g1212995 | BLASTN | 1487 | 1e-115 | 85 |
| 1515 | 69 | LIB3069-026-Q1-K1-E11 | LIB3069 | g1212995 | BLASTN | 1453 | 1e-112 | 85 |
| 1516 | 69 | LIB3066-006-Q1-K1-G12 | LIB3066 | g1212995 | BLASTN | 1077 | 1e-107 | 83 |
| 1517 | 69 | LIB3067-027-Q1-K1-D12 | LIB3067 | g1212995 | BLASTN | 1401 | 1e-107 | 86 |
| 1518 | 69 | LIB189-010-Q1-E1-H10 | LIB189 | g1212995 | BLASTN | 1368 | 1e-105 | 85 |
| 1519 | 69 | LIB3066-015-Q1-K1-G12 | LIB3066 | g1212995 | BLASTN | 1289 | 1e-104 | 82 |
| 1520 | 69 | LIB3061-016-Q1-K1-G11 | LIB3061 | g1212995 | BLASTN | 1180 | 1e-102 | 84 |
| 1521 | 69 | LIB3059-032-Q1-K1-G11 | LIB3059 | g1212995 | BLASTN | 1334 | 1e-102 | 87 |
| 1522 | 69 | LIB3067-059-Q1-K1-G12 | LIB3067 | g1212995 | BLASTN | 1090 | 1e-100 | 85 |
| 1523 | 69 | LIB3061-049-Q1-K1-C8 | LIB3061 | g1212995 | BLASTN | 1223 | 1e-98 | 79 |
| 1524 | 69 | LIB3062-044-Q1-K1-F2 | LIB3062 | g1212995 | BLASTN | 1259 | 1e-96 | 83 |
| 1525 | 69 | LIB3061-010-Q1-K1-F5 | LIB3061 | g1212995 | BLASTN | 1180 | 1e-95 | 84 |
| 1526 | 69 | LIB3067-018-Q1-K1-A12 | LIB3067 | g1212995 | BLASTN | 1127 | 1e-89 | 82 |
| 1527 | 69 | LIB3067-030-Q1-K1-F4 | LIB3067 | g1212995 | BLASTN | 1171 | 1e-88 | 83 |
| 1528 | 69 | LIB3062-021-Q1-K1-F10 | LIB3062 | g1212995 | BLASTN | 1138 | 1e-86 | 87 |
| 1529 | 69 | LIB3061-034-Q1-K1-D8 | LIB3061 | g1212995 | BLASTN | 1148 | 1e-86 | 85 |
| 1530 | 69 | LIB3066-049-Q1-K1-C1 | LIB3066 | g1212995 | BLASTN | 1134 | 1e-85 | 83 |
| 1531 | 69 | LIB3078-002-Q1-K1-F5 | LIB3078 | g1212995 | BLASTN | 859 | 1e-77 | 86 |
| 1532 | 69 | LIB84-011-Q1-E1-G9 | LIB84 | g1212995 | BLASTN | 1020 | 1e-76 | 83 |
| 1533 | 69 | LIB3067-043-Q1-K1-D2 | LIB3067 | g1212995 | BLASTN | 574 | 1e-59 | 77 |
| 1534 | 69 | LIB189-003-Q1-E1-G5 | LIB189 | g1212995 | BLASTN | 247 | 1e-40 | 77 |
| 1535 | 69 | LIB3062-008-Q1-K1-E6 | LIB3062 | g1212995 | BLASTN | 576 | 1e-37 | 63 |
| 1536 | 69 | LIB189-016-Q1-E1-H7 | LIB189 | g1212996 | BLASTX | 156 | 1e-30 | 78 |
| 1537 | 69 | LIB3067-007-Q1-K1-G4 | LIB3067 | g1212996 | BLASTX | 145 | 1e-28 | 82 |
| SOYBEAN TRIOSE PHOSPHATE ISOMERASE | | | | | | | | |
| 1538 | -700743237 | 700743237H1 | SOYMON012 | g407525 | BLASTX | 173 | 1e-17 | 91 |
| 1539 | -700977730 | 700977730H1 | SOYMON009 | g602589 | BLASTN | 373 | 1e-20 | 71 |
| 1540 | -701056176 | 701056176H1 | SOYMON032 | g806311 | BLASTN | 752 | 1e-53 | 74 |
| 1541 | -701110172 | 701110172H1 | SOYMON036 | g806311 | BLASTN | 801 | 1e-57 | 78 |
| 1542 | 10244 | 700995141H1 | SOYMON011 | g806311 | BLASTN | 470 | 1e-30 | 87 |
| 1543 | 10244 | 701124548H1 | SOYMON037 | g806311 | BLASTN | 490 | 1e-30 | 88 |
| 1544 | 10244 | 700739771H1 | SOYMON012 | g806311 | BLASTN | 329 | 1e-16 | 77 |
| 1545 | 10244 | 700999820H1 | SOYMON018 | g806312 | BLASTX | 147 | 1e-13 | 84 |
| 1546 | 10244 | 701119858H1 | SOYMON037 | g806312 | BLASTX | 118 | 1e-9 | 72 |
| 1547 | 10535 | 700988684H1 | SOYMON009 | g806311 | BLASTN | 905 | 1e-66 | 79 |
| 1548 | 10535 | 700902425H1 | SOYMON027 | g806311 | BLASTN | 872 | 1e-63 | 80 |
| 1549 | 1357 | 701069004H1 | SOYMON034 | g806311 | BLASTN | 832 | 1e-60 | 81 |
| 1550 | 1357 | 701151554H1 | SOYMON031 | g806311 | BLASTN | 568 | 1e-38 | 82 |
| 1551 | 1357 | 700659936H1 | SOYMON004 | g806311 | BLASTN | 545 | 1e-36 | 79 |
| 1552 | 16 | 700680927H1 | SOYMON008 | g256119 | BLASTN | 1020 | 1e-81 | 78 |
| 1553 | 16 | 700655871H1 | SOYMON004 | g256119 | BLASTN | 903 | 1e-66 | 81 |
| 1554 | 16 | 701124364H1 | SOYMON037 | g256119 | BLASTN | 872 | 1e-64 | 80 |
| 1555 | 16 | 701134707H2 | SOYMON038 | g256119 | BLASTN | 874 | 1e-64 | 81 |
| 1556 | 16 | 700673750H1 | SOYMON007 | g256119 | BLASTN | 781 | 1e-60 | 81 |
| 1557 | 16 | 701123269H1 | SOYMON037 | g602589 | BLASTN | 819 | 1e-59 | 78 |
| 1558 | 16 | 701004846H1 | SOYMON019 | g256119 | BLASTN | 801 | 1e-58 | 80 |

TABLE A*-continued

| Seq No. | Cluster ID | CloneID | Library | NCBI gi | Method | Score | P-value | % Ident |
|---|---|---|---|---|---|---|---|---|
| 1559 | 16 | 700993362H1 | SOYMON011 | g256119 | BLASTN | 808 | 1e-58 | 80 |
| 1560 | 16 | 701005445H1 | SOYMON019 | g256119 | BLASTN | 630 | 1e-56 | 78 |
| 1561 | 16 | 701134327H1 | SOYMON038 | g602589 | BLASTN | 782 | 1e-56 | 79 |
| 1562 | 16 | 701148169H1 | SOYMON031 | g602589 | BLASTN | 574 | 1e-51 | 76 |
| 1563 | 16 | 701153410H1 | SOYMON031 | g602589 | BLASTN | 451 | 1e-50 | 80 |
| 1564 | 16 | 700830168H1 | SOYMON019 | g256119 | BLASTN | 705 | 1e-50 | 77 |
| 1565 | 16 | 701120627H1 | SOYMON037 | g602589 | BLASTN | 715 | 1e-50 | 78 |
| 1566 | 16 | 700975358H1 | SOYMON009 | g602589 | BLASTN | 628 | 1e-49 | 77 |
| 1567 | 16 | 700755979H1 | SOYMON014 | g602589 | BLASTN | 697 | 1e-49 | 79 |
| 1568 | 16 | 701131374H1 | SOYMON038 | g602589 | BLASTN | 703 | 1e-49 | 79 |
| 1569 | 16 | 700994166H1 | SOYMON011 | g602589 | BLASTN | 513 | 1e-47 | 77 |
| 1570 | 16 | 701138038H1 | SOYMON038 | g602589 | BLASTN | 672 | 1e-47 | 77 |
| 1571 | 16 | 700974248H1 | SOYMON005 | g602589 | BLASTN | 658 | 1e-46 | 77 |
| 1572 | 16 | 700655832H1 | SOYMON004 | g602589 | BLASTN | 664 | 1e-46 | 78 |
| 1573 | 16 | 700758320H1 | SOYMON015 | g602589 | BLASTN | 409 | 1e-45 | 80 |
| 1574 | 16 | 701064709H1 | SOYMON034 | g602589 | BLASTN | 477 | 1e-45 | 78 |
| 1575 | 16 | 701138504H1 | SOYMON038 | g602589 | BLASTN | 591 | 1e-45 | 76 |
| 1576 | 16 | 700980284H1 | SOYMON009 | g602589 | BLASTN | 652 | 1e-45 | 79 |
| 1577 | 16 | 701133585H2 | SOYMON038 | g602589 | BLASTN | 634 | 1e-44 | 78 |
| 1578 | 16 | 700674706H1 | SOYMON007 | g602589 | BLASTN | 634 | 1e-44 | 78 |
| 1579 | 16 | 700964927H1 | SOYMON022 | g602589 | BLASTN | 639 | 1e-44 | 78 |
| 1580 | 16 | 700830923H1 | SOYMON019 | g602589 | BLASTN | 626 | 1e-43 | 76 |
| 1581 | 16 | 700662845H1 | SOYMON005 | g602589 | BLASTN | 617 | 1e-42 | 76 |
| 1582 | 16 | 701133824H1 | SOYMON038 | g602589 | BLASTN | 619 | 1e-42 | 78 |
| 1583 | 16 | 700848913H1 | SOYMON021 | g602589 | BLASTN | 603 | 1e-41 | 77 |
| 1584 | 16 | 701005984H1 | SOYMON019 | g602589 | BLASTN | 604 | 1e-41 | 78 |
| 1585 | 16 | 701140769H1 | SOYMON038 | g602589 | BLASTN | 605 | 1e-41 | 76 |
| 1586 | 16 | 700753357H1 | SOYMON014 | g602589 | BLASTN | 328 | 1e-40 | 78 |
| 1587 | 16 | 701056336H1 | SOYMON032 | g602589 | BLASTN | 344 | 1e-40 | 77 |
| 1588 | 16 | 700895411H1 | SOYMON027 | g602589 | BLASTN | 593 | 1e-40 | 78 |
| 1589 | 16 | 701060188H1 | SOYMON033 | g602589 | BLASTN | 277 | 1e-39 | 80 |
| 1590 | 16 | 700739461H1 | SOYMON012 | g602589 | BLASTN | 573 | 1e-39 | 77 |
| 1591 | 16 | 700941104H1 | SOYMON024 | g602589 | BLASTN | 579 | 1e-39 | 79 |
| 1592 | 16 | 700732960H1 | SOYMON010 | g602589 | BLASTN | 581 | 1e-39 | 78 |
| 1593 | 16 | 700686476H1 | SOYMON008 | g602589 | BLASTN | 583 | 1e-39 | 79 |
| 1594 | 16 | 701054231H1 | SOYMON032 | g602589 | BLASTN | 583 | 1e-39 | 77 |
| 1595 | 16 | 700671690H1 | SOYMON006 | g602589 | BLASTN | 566 | 1e-38 | 77 |
| 1596 | 16 | 700941174H1 | SOYMON024 | g602589 | BLASTN | 569 | 1e-38 | 78 |
| 1597 | 16 | 701125091H1 | SOYMON037 | g256119 | BLASTN | 358 | 1e-37 | 74 |
| 1598 | 16 | 700989827H1 | SOYMON011 | g602589 | BLASTN | 555 | 1e-37 | 78 |
| 1599 | 16 | 700835006H1 | SOYMON019 | g602589 | BLASTN | 555 | 1e-37 | 75 |
| 1600 | 16 | 700834847H1 | SOYMON019 | g602589 | BLASTN | 559 | 1e-37 | 78 |
| 1601 | 16 | 700953411H1 | SOYMON022 | g602589 | BLASTN | 314 | 1e-36 | 80 |
| 1602 | 16 | 700869222H1 | SOYMON016 | g602589 | BLASTN | 541 | 1e-36 | 78 |
| 1603 | 16 | 700850633H1 | SOYMON023 | g602589 | BLASTN | 544 | 1e-36 | 78 |
| 1604 | 16 | 700890283H1 | SOYMON024 | g602589 | BLASTN | 310 | 1e-35 | 80 |
| 1605 | 16 | 700727079H1 | SOYMON009 | g414549 | BLASTN | 358 | 1e-35 | 73 |
| 1606 | 16 | 700892544H1 | SOYMON024 | g602589 | BLASTN | 486 | 1e-35 | 78 |
| 1607 | 16 | 700869230H1 | SOYMON016 | g602589 | BLASTN | 528 | 1e-35 | 78 |
| 1608 | 16 | 700993034H1 | SOYMON011 | g602589 | BLASTN | 518 | 1e-34 | 75 |
| 1609 | 16 | 700975553H1 | SOYMON009 | g414549 | BLASTN | 524 | 1e-34 | 79 |
| 1610 | 16 | 700651326H1 | SOYMON003 | g602589 | BLASTN | 356 | 1e-33 | 80 |
| 1611 | 16 | 701215308H1 | SOYMON035 | g414549 | BLASTN | 450 | 1e-33 | 75 |
| 1612 | 16 | 700654480H1 | SOYMON004 | g414549 | BLASTN | 511 | 1e-33 | 80 |
| 1613 | 16 | 701045128H1 | SOYMON032 | g414549 | BLASTN | 512 | 1e-33 | 78 |
| 1614 | 16 | 701060759H1 | SOYMON033 | g414549 | BLASTN | 513 | 1e-33 | 80 |
| 1615 | 16 | 700741652H1 | SOYMON012 | g602589 | BLASTN | 493 | 1e-32 | 79 |
| 1616 | 16 | 700675469H1 | SOYMON007 | g602589 | BLASTN | 494 | 1e-32 | 78 |
| 1617 | 16 | 700657787H1 | SOYMON004 | g414549 | BLASTN | 495 | 1e-32 | 79 |
| 1618 | 16 | 701009957H2 | SOYMON019 | g414549 | BLASTN | 495 | 1e-32 | 80 |
| 1619 | 16 | 700983693H1 | SOYMON009 | g414549 | BLASTN | 495 | 1e-32 | 80 |
| 1620 | 16 | 701156784H1 | SOYMON031 | g602589 | BLASTN | 495 | 1e-32 | 78 |
| 1621 | 16 | 700893935H1 | SOYMON024 | g602589 | BLASTN | 481 | 1e-31 | 79 |
| 1622 | 16 | 701144619H1 | SOYMON031 | g414549 | BLASTN | 485 | 1e-31 | 78 |
| 1623 | 16 | 701148851H1 | SOYMON031 | g602589 | BLASTN | 487 | 1e-31 | 79 |
| 1624 | 16 | 701058218H1 | SOYMON033 | g602589 | BLASTN | 495 | 1e-31 | 78 |
| 1625 | 16 | 700975165H1 | SOYMON009 | g414549 | BLASTN | 466 | 1e-30 | 80 |
| 1626 | 16 | 701100165H1 | SOYMON028 | g602589 | BLASTN | 485 | 1e-30 | 79 |
| 1627 | 16 | 701150241H1 | SOYMON031 | g602589 | BLASTN | 455 | 1e-29 | 79 |
| 1628 | 16 | 701098308H1 | SOYMON028 | g414549 | BLASTN | 460 | 1e-29 | 79 |
| 1629 | 16 | 701150440H1 | SOYMON031 | g602589 | BLASTN | 462 | 1e-29 | 78 |
| 1630 | 16 | 700685125H1 | SOYMON008 | g414549 | BLASTN | 471 | 1e-29 | 81 |
| 1631 | 16 | 701061565H1 | SOYMON033 | g414549 | BLASTN | 471 | 1e-29 | 81 |
| 1632 | 16 | 700991418H1 | SOYMON011 | g602589 | BLASTN | 394 | 1e-28 | 68 |
| 1633 | 16 | 701156156H1 | SOYMON031 | g602589 | BLASTN | 456 | 1e-28 | 78 |
| 1634 | 16 | 701007231H2 | SOYMON019 | g602589 | BLASTN | 461 | 1e-28 | 79 |
| 1635 | 16 | 700829667H1 | SOYMON019 | g414549 | BLASTN | 333 | 1e-27 | 73 |

TABLE A*-continued

| Seq No. | Cluster ID | CloneID | Library | NCBI gi | Method | Score | P-value | % Ident |
|---|---|---|---|---|---|---|---|---|
| 1636 | 16 | 701156033H1 | SOYMON031 | g602589 | BLASTN | 432 | 1e-27 | 78 |
| 1637 | 16 | 701014293H1 | SOYMON019 | g414549 | BLASTN | 446 | 1e-27 | 77 |
| 1638 | 16 | 701152138H1 | SOYMON031 | g414549 | BLASTN | 450 | 1e-27 | 81 |
| 1639 | 16 | 700945665H1 | SOYMON024 | g414549 | BLASTN | 450 | 1e-27 | 81 |
| 1640 | 16 | 701001407H1 | SOYMON018 | g169820 | BLASTN | 219 | 1e-26 | 72 |
| 1641 | 16 | 700983185H1 | SOYMON009 | g414549 | BLASTN | 435 | 1e-26 | 72 |
| 1642 | 16 | 700752364H1 | SOYMON014 | g414549 | BLASTN | 441 | 1e-26 | 76 |
| 1643 | 16 | 700992409H1 | SOYMON011 | g414549 | BLASTN | 427 | 1e-25 | 75 |
| 1644 | 16 | 701109396H1 | SOYMON036 | g414549 | BLASTN | 420 | 1e-24 | 76 |
| 1645 | 16 | 701151402H1 | SOYMON031 | g556171 | BLASTX | 151 | 1e-23 | 85 |
| 1646 | 16 | 701149617H1 | SOYMON031 | g556171 | BLASTX | 158 | 1e-23 | 86 |
| 1647 | 16 | 700747310H1 | SOYMON013 | g414549 | BLASTN | 406 | 1e-23 | 73 |
| 1648 | 16 | 701139569H1 | SOYMON038 | g556171 | BLASTX | 191 | 1e-22 | 84 |
| 1649 | 16 | 701213275H1 | SOYMON035 | g602589 | BLASTN | 255 | 1e-22 | 80 |
| 1650 | 16 | 701157185H1 | SOYMON031 | g556171 | BLASTX | 197 | 1e-20 | 90 |
| 1651 | 16 | 700655520H1 | SOYMON004 | g556171 | BLASTX | 166 | 1e-19 | 86 |
| 1652 | 16 | 701010779H1 | SOYMON019 | g556171 | BLASTX | 173 | 1e-19 | 64 |
| 1653 | 16 | 701044104H1 | SOYMON032 | g556171 | BLASTX | 188 | 1e-19 | 89 |
| 1654 | 16 | 700867605H1 | SOYMON016 | g556171 | BLASTX | 160 | 1e-17 | 70 |
| 1655 | 16 | 701058593H1 | SOYMON033 | g168647 | BLASTX | 169 | 1e-16 | 94 |
| 1656 | 16 | 701070286H1 | SOYMON034 | g168647 | BLASTX | 164 | 1e-15 | 91 |
| 1657 | 16 | 700877219H1 | SOYMON018 | g168647 | BLASTX | 154 | 1e-14 | 93 |
| 1658 | 16 | 700876790H1 | SOYMON018 | g168647 | BLASTX | 154 | 1e-14 | 93 |
| 1659 | 16 | 700877212H1 | SOYMON018 | g168647 | BLASTX | 154 | 1e-14 | 93 |
| 1660 | 16 | 700760847H1 | SOYMON015 | g556171 | BLASTX | 138 | 1e-13 | 86 |
| 1661 | 16 | 700893711H1 | SOYMON024 | g168647 | BLASTX | 140 | 1e-13 | 82 |
| 1662 | 16 | 700557532H1 | SOYMON001 | g256120 | BLASTX | 115 | 1e-12 | 88 |
| 1663 | 16 | 700793802H1 | SOYMON017 | g556171 | BLASTX | 138 | 1e-12 | 93 |
| 1664 | 16 | 700659725H1 | SOYMON004 | g556171 | BLASTX | 144 | 1e-12 | 47 |
| 1665 | 16 | 701044545H1 | SOYMON032 | g556171 | BLASTX | 144 | 1e-12 | 92 |
| 1666 | 16 | 701037485H1 | SOYMON029 | g556171 | BLASTX | 135 | 1e-11 | 96 |
| 1667 | 16 | 700683524H1 | SOYMON008 | g168647 | BLASTX | 136 | 1e-11 | 90 |
| 1668 | 16 | 700876711H1 | SOYMON018 | g168647 | BLASTX | 109 | 1e-10 | 85 |
| 1669 | 16 | 701155437H1 | SOYMON031 | g556171 | BLASTX | 130 | 1e-10 | 92 |
| 1670 | 28599 | 700997892H1 | SOYMON018 | g806311 | BLASTN | 834 | 1e-60 | 78 |
| 1671 | 31 | 701053174H1 | SOYMON032 | g806311 | BLASTN | 572 | 1e-37 | 73 |
| 1672 | 31 | 700754467H1 | SOYMON014 | g806312 | BLASTX | 145 | 1e-21 | 66 |
| 1673 | 31 | 701107430H1 | SOYMON036 | g806312 | BLASTX | 199 | 1e-20 | 63 |
| 1674 | 31 | 700985855H1 | SOYMON009 | g806312 | BLASTX | 145 | 1e-18 | 64 |
| 1675 | 31 | 701038167H1 | SOYMON029 | g806312 | BLASTX | 179 | 1e-17 | 61 |
| 1676 | 31 | 700670393H1 | SOYMON006 | g806312 | BLASTX | 167 | 1e-16 | 78 |
| 1677 | 31 | 700559280H1 | SOYMON001 | g609262 | BLASTX | 164 | 1e-15 | 69 |
| 1678 | 31 | 700793048H1 | SOYMON017 | g806312 | BLASTX | 97 | 1e-12 | 60 |
| 1679 | 31 | 700993683H1 | SOYMON011 | g806312 | BLASTX | 103 | 1e-11 | 60 |
| 1680 | 31 | 700663233H1 | SOYMON005 | g806312 | BLASTX | 130 | 1e-11 | 56 |
| 1681 | 31 | 700908079H1 | SOYMON022 | g806312 | BLASTX | 103 | 1e-10 | 60 |
| 1682 | 31 | 701043447H1 | SOYMON029 | g609262 | BLASTX | 126 | 1e-10 | 84 |
| 1683 | 31 | 700740188H1 | SOYMON012 | g806312 | BLASTX | 103 | 1e-8 | 60 |
| 1684 | 7466 | 700742922H1 | SOYMON012 | g806311 | BLASTN | 435 | 1e-27 | 76 |
| 1685 | 7466 | 700606255H1 | SOYMON008 | g806312 | BLASTX | 117 | 1e-17 | 80 |
| 1686 | 16 | LIB3053-005-Q1-N1-F9 | LIB3053 | g602589 | BLASTN | 1000 | 1e-74 | 77 |
| 1687 | 16 | LIB3039-035-Q1-E1-C5 | LIB3039 | g602589 | BLASTN | 979 | 1e-72 | 78 |
| 1688 | 16 | LIB3039-031-Q1-E1-A8 | LIB3039 | g256119 | BLASTN | 911 | 1e-71 | 80 |
| 1689 | 16 | LIB3030-003-Q1-B1-C9 | LIB3030 | g602589 | BLASTN | 949 | 1e-70 | 78 |
| 1690 | 16 | LIB3039-023-Q1-E1-H12 | LIB3039 | g602589 | BLASTN | 913 | 1e-67 | 78 |
| 1691 | 16 | LIB3039-047-Q1-E1-D8 | LIB3039 | g602589 | BLASTN | 566 | 1e-65 | 75 |
| 1692 | 16 | LIB3039-052-Q1-E1-D6 | LIB3039 | g602589 | BLASTN | 890 | 1e-65 | 77 |
| 1693 | 16 | LIB3039-051-Q1-E1-A1 | LIB3039 | g602589 | BLASTN | 855 | 1e-62 | 78 |
| 1694 | 16 | LIB3049-009-Q1-E1-G5 | LIB3049 | g602589 | BLASTN | 783 | 1e-56 | 78 |
| 1695 | 16 | LIB3039-009-Q1-E1-C1 | LIB3039 | g602589 | BLASTN | 805 | 1e-56 | 78 |
| 1696 | 16 | LIB3055-006-Q1-N1-H3 | LIB3055 | g256119 | BLASTN | 481 | 1e-54 | 78 |
| 1697 | 16 | LIB3055-013-Q1-N1-C3 | LIB3055 | g256119 | BLASTN | 769 | 1e-54 | 79 |
| 1698 | 16 | LIB3049-034-Q1-E1-A2 | LIB3049 | g602589 | BLASTN | 626 | 1e-51 | 76 |

TABLE A*-continued

| Seq No. | Cluster ID | CloneID | Library | NCBI gi | Method | Score | P-value | % Ident |
|---|---|---|---|---|---|---|---|---|
| 1699 | 16 | LIB3049-022-Q1-E1-F9 | LIB3049 | g602589 | BLASTN | 519 | 1e-43 | 78 |
| 1700 | 16 | LIB3049-030-Q1-E1-C7 | LIB3049 | g602589 | BLASTN | 572 | 1e-38 | 77 |
| 1701 | 16 | LIB3040-035-Q1-E1-C5 | LIB3040 | g556171 | BLASTX | 175 | 1e-33 | 82 |
| 1702 | 16 | LIB3040-005-Q1-E1-H8 | LIB3040 | g169820 | BLASTN | 324 | 1e-33 | 76 |
| 1703 | 16 | LIB3028-025-Q1-B1-D1 | LIB3028 | g602589 | BLASTN | 464 | 1e-33 | 78 |
| 1704 | 16 | LIB3039-022-Q1-E1-D5 | LIB3039 | g602589 | BLASTN | 357 | 1e-32 | 73 |
| 1705 | 16 | LIB3052-001-Q1-B1-C5 | LIB3052 | G414549 | BLASTN | 327 | 1e-29 | 73 |
| 1706 | 28599 | LIB3039-047-Q1-E1-D9 | LIB3039 | G806311 | BLASTN | 1183 | 1e-94 | 81 |
| 1707 | 28599 | LIB3039-048-Q1-E1-D12 | LIB3039 | G806311 | BLASTN | 1007 | 1e-92 | 81 |
| | | SOYBEAN FRUCTOSE 1,6-BISPHOSPHATE ALDOLASE | | | | | | |
| 1708 | 00565253 | 700565253H1 | SOYMON002 | G3021337 | BLASTN | 352 | 1e-39 | 76 |
| 1709 | −700865276 | 700865276H1 | SOYMON016 | G3021337 | BLASTN | 629 | 1e-43 | 76 |
| 1710 | −700873022 | 700873022H1 | SOYMON018 | G3696 | BLASTX | 211 | 1e-26 | 70 |
| 1711 | −700943855 | 700943855H1 | SOYMON024 | G20204 | BLASTX | 202 | 1e-20 | 86 |
| 1712 | −700974965 | 700974965H1 | SOYMON005 | g3021337 | BLASTN | 259 | 1e-10 | 84 |
| 1713 | −701039850 | 701039850H1 | SOYMON029 | g22632 | BLASTN | 408 | 1e-23 | 76 |
| 1714 | −701206840 | 701206840H1 | SOYMON035 | g3021338 | BLASTX | 151 | 1e-13 | 83 |
| 1715 | 11792 | 700654881H1 | SOYMON004 | g20204 | BLASTX | 150 | 1e-13 | 76 |
| 1716 | 11792 | 700746016H1 | SOYMON013 | g3021337 | BLASTN | 284 | 1e-12 | 67 |
| 1717 | 12314 | 701037190H1 | SOYMON029 | g3021337 | BLASTN | 634 | 1e-44 | 78 |
| 1718 | 12314 | 701042664H1 | SOYMON035 | g3021338 | BLASTX | 197 | 1e-20 | 66 |
| 1719 | 16 | 700651596H1 | SOYMON003 | g3021337 | BLASTN | 1101 | 1e-83 | 86 |
| 1720 | 16 | 700750439H1 | SOYMON013 | g3021337 | BLASTN | 1078 | 1e-81 | 86 |
| 1721 | 16 | 700649475H1 | SOYMON003 | g3021337 | BLASTN | 1082 | 1e-81 | 84 |
| 1722 | 16 | 700652995H1 | SOYMON003 | g3021337 | BLASTN | 1084 | 1e-81 | 82 |
| 1723 | 16 | 700981967H1 | SOYMON009 | g3021337 | BLASTN | 1071 | 1e-80 | 85 |
| 1724 | 16 | 700863243H1 | SOYMON023 | g3021337 | BLASTN | 1044 | 1e-78 | 86 |
| 1725 | 16 | 700558625H1 | SOYMON001 | g3021337 | BLASTN | 1041 | 1e-77 | 84 |
| 1726 | 16 | 700564806H1 | SOYMON002 | g3021337 | BLASTN | 1021 | 1e-76 | 80 |
| 1727 | 16 | 700746368H1 | SOYMON013 | g3021337 | BLASTN | 897 | 1e-75 | 86 |
| 1728 | 16 | 700960290H1 | SOYMON022 | g3021337 | BLASTN | 1009 | 1e-75 | 87 |
| 1729 | 16 | 701055132H1 | SOYMON032 | g3021337 | BLASTN | 1011 | 1e-75 | 86 |
| 1730 | 16 | 701056109H1 | SOYMON032 | g3021337 | BLASTN | 1012 | 1e-75 | 84 |
| 1731 | 16 | 701119884H1 | SOYMON037 | g3021337 | BLASTN | 1014 | 1e-75 | 87 |
| 1732 | 16 | 700898149H1 | SOYMON027 | g3021337 | BLASTN | 1015 | 1e-75 | 86 |
| 1733 | 16 | 700661436H1 | SOYMON005 | g3021337 | BLASTN | 596 | 1e-74 | 83 |
| 1734 | 16 | 701042223H1 | SOYMON029 | g3021337 | BLASTN | 997 | 1e-74 | 84 |
| 1735 | 16 | 700676004H1 | SOYMON007 | g3021337 | BLASTN | 984 | 1e-73 | 85 |
| 1736 | 16 | 700747718H1 | SOYMON013 | g3021337 | BLASTN | 988 | 1e-73 | 87 |
| 1737 | 16 | 700751133H1 | SOYMON014 | g3021337 | BLASTN | 989 | 1e-73 | 86 |
| 1738 | 16 | 701215247H1 | SOYMON035 | g3021337 | BLASTN | 989 | 1e-73 | 84 |
| 1739 | 16 | 700652484H1 | SOYMON003 | g3021337 | BLASTN | 910 | 1e-72 | 85 |
| 1740 | 16 | 700869785H1 | SOYMON016 | g3021337 | BLASTN | 970 | 1e-72 | 87 |
| 1741 | 16 | 700981960H1 | SOYMON009 | g3021337 | BLASTN | 970 | 1e-72 | 87 |
| 1742 | 16 | 700969335H1 | SOYMON005 | g3021337 | BLASTN | 972 | 1e-72 | 82 |
| 1743 | 16 | 700854174H1 | SOYMON023 | g3021337 | BLASTN | 965 | 1e-71 | 84 |
| 1744 | 16 | 700761638H1 | SOYMON015 | g3021337 | BLASTN | 966 | 1e-71 | 86 |
| 1745 | 16 | 700984860H1 | SOYMON009 | g3021337 | BLASTN | 967 | 1e-71 | 84 |
| 1746 | 16 | 701005716H1 | SOYMON019 | g3021337 | BLASTN | 967 | 1e-71 | 83 |
| 1747 | 16 | 700941053H1 | SOYMON024 | g3021337 | BLASTN | 968 | 1e-71 | 86 |
| 1748 | 16 | 700561358H1 | SOYMON002 | g3021337 | BLASTN | 968 | 1e-71 | 82 |
| 1749 | 16 | 700564906H1 | SOYMON002 | g3021337 | BLASTN | 562 | 1e-70 | 82 |
| 1750 | 16 | 700833951H1 | SOYMON019 | g3021337 | BLASTN | 954 | 1e-70 | 88 |
| 1751 | 16 | 701117626H1 | SOYMON037 | g3021337 | BLASTN | 957 | 1e-70 | 85 |
| 1752 | 16 | 700729103H1 | SOYMON009 | g3021337 | BLASTN | 535 | 1e-69 | 86 |
| 1753 | 16 | 700670615H1 | SOYMON006 | g3021337 | BLASTN | 936 | 1e-69 | 83 |
| 1754 | 16 | 701053635H1 | SOYMON032 | g3021337 | BLASTN | 941 | 1e-69 | 84 |
| 1755 | 16 | 700982280H1 | SOYMON009 | g3021337 | BLASTN | 923 | 1e-68 | 82 |
| 1756 | 16 | 701119874H1 | SOYMON037 | g3021337 | BLASTN | 925 | 1e-68 | 88 |
| 1757 | 16 | 700758937H1 | SOYMON015 | g3021337 | BLASTN | 926 | 1e-68 | 87 |
| 1758 | 16 | 701214027H1 | SOYMON035 | g3021337 | BLASTN | 928 | 1e-68 | 82 |
| 1759 | 16 | 700972858H1 | SOYMON005 | g3021337 | BLASTN | 929 | 1e-68 | 84 |
| 1760 | 16 | 701099780H1 | SOYMON028 | g3021337 | BLASTN | 930 | 1e-68 | 85 |
| 1761 | 16 | 700829560H1 | SOYMON019 | g3021337 | BLASTN | 932 | 1e-68 | 85 |
| 1762 | 16 | 700971973H1 | SOYMON005 | g3021337 | BLASTN | 576 | 1e-67 | 85 |
| 1763 | 16 | 701142336H1 | SOYMON038 | g3021337 | BLASTN | 750 | 1e-67 | 81 |
| 1764 | 16 | 701132605H1 | SOYMON038 | g3021337 | BLASTN | 759 | 1e-67 | 85 |

TABLE A*-continued

| Seq No. | Cluster ID | CloneID | Library | NCBI gi | Method | Score | P-value | % Ident |
|---|---|---|---|---|---|---|---|---|
| 1765 | 16 | 700969222H1 | SOYMON005 | g3021337 | BLASTN | 913 | 1e-67 | 84 |
| 1766 | 16 | 700670956H1 | SOYMON006 | g3021337 | BLASTN | 920 | 1e-67 | 84 |
| 1767 | 16 | 700895725H1 | SOYMON027 | g3021337 | BLASTN | 921 | 1e-67 | 84 |
| 1768 | 16 | 701013771H1 | SOYMON019 | g3021337 | BLASTN | 921 | 1e-67 | 81 |
| 1769 | 16 | 701055481H1 | SOYMON032 | g3021337 | BLASTN | 654 | 1e-66 | 80 |
| 1770 | 16 | 700753940H1 | SOYMON014 | g3021337 | BLASTN | 899 | 1e-66 | 84 |
| 1771 | 16 | 700974141H1 | SOYMON005 | g3021337 | BLASIN | 900 | 1e-66 | 81 |
| 1772 | 16 | 700562408H1 | SOYMON002 | g3021337 | BLASTN | 902 | 1e-66 | 82 |
| 1773 | 16 | 700685292H1 | SOYMON008 | g3021337 | BLASTN | 903 | 1e-66 | 83 |
| 1774 | 16 | 700985157H1 | SOYMON009 | g3021337 | BLASTN | 907 | 1e-66 | 82 |
| 1775 | 16 | 701038194H1 | SOYMON029 | g3021337 | BLASTN | 907 | 1e-66 | 82 |
| 1776 | 16 | 700986633H1 | SOYMON009 | g3021337 | BLASTN | 908 | 1e-66 | 83 |
| 1777 | 16 | 700564282H1 | SOYMON002 | g3021337 | BLASTN | 517 | 1e-65 | 83 |
| 1778 | 16 | 700733754H1 | SOYMON010 | g3021337 | BLASTN | 680 | 1e-65 | 84 |
| 1779 | 16 | 700988179H1 | SOYMON009 | g3021337 | BLASTN | 887 | 1e-65 | 82 |
| 1780 | 16 | 700555591H1 | SOYMON001 | g3021337 | BLASTN | 887 | 1e-65 | 82 |
| 1781 | 16 | 701206717H1 | SOYMON035 | g3021337 | BLASTN | 888 | 1e-65 | 81 |
| 1782 | 16 | 700968494H1 | SOYMON036 | g3021337 | BLASTN | 889 | 1e-65 | 86 |
| 1783 | 16 | 700906271H1 | SOYMON022 | g3021337 | BLASTN | 894 | 1e-65 | 82 |
| 1784 | 16 | 700677674H1 | SOYMON007 | g3021337 | BLASTN | 894 | 1e-65 | 83 |
| 1785 | 16 | 700970391H1 | SOYMON005 | g3021337 | BLASTN | 896 | 1e-65 | 83 |
| 1786 | 16 | 700753641H1 | SOYMON014 | g3021337 | BLASTN | 897 | 1e-65 | 82 |
| 1787 | 16 | 700646593H1 | SOYMON014 | g3021337 | BLASTN | 468 | 1e-64 | 80 |
| 1788 | 16 | 700565615H1 | SOYMON002 | g3021337 | BLASTN | 667 | 1e-64 | 80 |
| 1789 | 16 | 700746523H1 | SOYMON013 | g3021337 | BLASTN | 744 | 1e-64 | 83 |
| 1790 | 16 | 700899019H1 | SOYMON027 | g3021337 | BLASTN | 875 | 1e-64 | 83 |
| 1791 | 16 | 701127167H1 | SOYMON037 | g3021337 | BLASTN | 876 | 1e-64 | 84 |
| 1792 | 16 | 701131053H1 | SOYMON038 | g3021337 | BLASTN | 879 | 1e-64 | 84 |
| 1793 | 16 | 700670980H1 | SOYMON006 | g3021337 | BLASTN | 881 | 1e-64 | 83 |
| 1794 | 16 | 701055811H1 | SOYMON032 | g3021337 | BLASTN | 881 | 1e-64 | 85 |
| 1795 | 16 | 700900103H1 | SOYMON027 | g3021337 | BLASTN | 882 | 1e-64 | 83 |
| 1796 | 16 | 700975609H1 | SOYMON009 | g3021337 | BLASTN | 882 | 1e-64 | 84 |
| 1797 | 16 | 701102865H1 | SOYMON028 | g3021337 | BLASTN | 883 | 1e-64 | 85 |
| 1798 | 16 | 701145255H1 | SOYMON031 | g3021337 | BLASTN | 509 | 1e-63 | 80 |
| 1799 | 16 | 701210875H1 | SOYMON035 | g3021337 | BLASTN | 616 | 1e-63 | 84 |
| 1800 | 16 | 700646664H1 | SOYMON014 | g3021337 | BLASTN | 862 | 1e-63 | 85 |
| 1801 | 16 | 700897337H1 | SOYMON027 | g3021337 | BLASTN | 865 | 1e-63 | 86 |
| 1802 | 16 | 700736783H1 | SOYMON010 | g3021337 | BLASTN | 867 | 1e-63 | 83 |
| 1803 | 16 | 701059586H1 | SOYMON033 | g3021337 | BLASTN | 869 | 1e-63 | 81 |
| 1804 | 16 | 701127063H1 | SOYMON037 | g3021337 | BLASTN | 412 | 1e-62 | 84 |
| 1805 | 16 | 700556614H1 | SOYMON001 | g3021337 | BLASTN | 475 | 1e-62 | 86 |
| 1806 | 16 | 700672681H1 | SOYMON006 | g3021337 | BLASTN | 818 | 1e-62 | 82 |
| 1807 | 16 | 700727057H1 | SOYMON009 | g3021337 | BLASTN | 850 | 1e-62 | 82 |
| 1808 | 16 | 701042141H1 | SOYMON029 | g3021337 | BLASTN | 851 | 1e-62 | 83 |
| 1809 | 16 | 700561860H1 | SOYMON002 | g3021337 | BLASTN | 854 | 1e-62 | 81 |
| 1810 | 16 | 700677460H1 | SOYMON007 | g3021337 | BLASTN | 855 | 1e-62 | 83 |
| 1811 | 16 | 700971671H1 | SOYMON005 | g3021337 | BLASTN | 856 | 1e-62 | 81 |
| 1812 | 16 | 700749578H1 | SOYMON013 | g3021337 | BLASTN | 856 | 1e-62 | 81 |
| 1813 | 16 | 700672288H1 | SOYMON006 | g3021337 | BLASTN | 860 | 1e-62 | 81 |
| 1814 | 16 | 701068481H1 | SOYMON034 | g3021337 | BLASTN | 861 | 1e-62 | 81 |
| 1815 | 16 | 700729913H1 | SOYMON009 | g3021337 | BLASTN | 661 | 1e-61 | 79 |
| 1816 | 16 | 700739449H1 | SOYMON012 | g3021337 | BLASTN | 724 | 1e-61 | 85 |
| 1817 | 16 | 700830902H1 | SOYMON019 | g3021337 | BLASTN | 814 | 1e-61 | 83 |
| 1818 | 16 | 700895304H1 | SOYMON027 | g3021337 | BLASTN | 840 | 1e-61 | 82 |
| 1819 | 16 | 700605676H2 | SOYMON005 | g3021337 | BLASTN | 842 | 1e-61 | 84 |
| 1820 | 16 | 700677453H1 | SOYMON007 | g3021337 | BLASTN | 843 | 1e-61 | 83 |
| 1821 | 16 | 700983108H1 | SOYMON009 | g3021337 | BLASTN | 843 | 1e-61 | 81 |
| 1822 | 16 | 700889170H1 | SOYMON024 | g3021337 | BLASTN | 845 | 1e-61 | 86 |
| 1823 | 16 | 701004956H1 | SOYMON019 | g3021337 | BLASTN | 849 | 1e-61 | 82 |
| 1824 | 16 | 700958213H1 | SOYMON022 | g3021337 | BLASTN | 849 | 1e-61 | 82 |
| 1825 | 16 | 701129305H1 | SOYMON037 | g3021337 | BLASTN | 659 | 1e-60 | 85 |
| 1826 | 16 | 701014446H1 | SOYMON019 | g3021337 | BLASTN | 669 | 1e-60 | 85 |
| 1827 | 16 | 700832047H1 | SOYMON019 | g3021337 | BLASTN | 738 | 1e-60 | 83 |
| 1828 | 16 | 700669966H1 | SOYMON006 | g3021337 | BLASTN | 829 | 1e-60 | 82 |
| 1829 | 16 | 700758028H1 | SOYMON015 | g3021337 | BLASTN | 829 | 1e-60 | 81 |
| 1830 | 16 | 700659491H1 | SOYMON004 | g3021337 | BLASTN | 829 | 1e-60 | 83 |
| 1831 | 16 | 701003560H1 | SOYMON019 | g3021337 | BLASTN | 829 | 1e-60 | 82 |
| 1832 | 16 | 701060964H1 | SOYMON033 | g3021337 | BLASTN | 833 | 1e-60 | 81 |
| 1833 | 16 | 700548284H1 | SOYMON002 | g3021337 | BLASTN | 834 | 1e-60 | 82 |
| 1834 | 16 | 700894957H1 | SOYMON024 | g3021337 | BLASTN | 837 | 1e-60 | 81 |
| 1835 | 16 | 700646551H1 | SOYMON014 | g3021337 | BLASTN | 479 | 1e-59 | 83 |
| 1836 | 16 | 700967633H1 | SOYMON032 | g3021337 | BLASTN | 530 | 1e-59 | 81 |
| 1837 | 16 | 700754430H1 | SOYMON014 | g3021337 | BLASTN | 654 | 1e-59 | 85 |
| 1838 | 16 | 700865919H1 | SOYMON016 | g3021337 | BLASTN | 814 | 1e-59 | 81 |
| 1839 | 16 | 700980426H1 | SOYMON009 | g3021337 | BLASTN | 815 | 1e-59 | 80 |
| 1840 | 16 | 701048203H1 | SOYMON032 | g3021337 | BLASTN | 816 | 1e-59 | 81 |
| 1841 | 16 | 700846414H1 | SOYMON021 | g3021337 | BLASTN | 819 | 1e-59 | 81 |

TABLE A*-continued

| Seq No. | Cluster ID | CloneID | Library | NCBI gi | Method | Score | P-value | % Ident |
|---|---|---|---|---|---|---|---|---|
| 1842 | 16 | 700851608H1 | SOYMON023 | g3021337 | BLASTN | 822 | 1e−59 | 81 |
| 1843 | 16 | 700970160H1 | SOYMON005 | g3021337 | BLASTN | 822 | 1e−59 | 82 |
| 1844 | 16 | 700834462H1 | SOYMON019 | g3021337 | BLASTN | 823 | 1e−59 | 81 |
| 1845 | 16 | 701206312H1 | SOYMON035 | g3021337 | BLASTN | 823 | 1e−59 | 85 |
| 1846 | 16 | 700562478H1 | SOYMON002 | g3021337 | BLASTN | 487 | 1e−58 | 84 |
| 1847 | 16 | 700788114H1 | SOYMON011 | g3021337 | BLASTN | 751 | 1e−58 | 83 |
| 1848 | 16 | 700753792H1 | SOYMON014 | g3021337 | BLASTN | 804 | 1e−58 | 84 |
| 1849 | 16 | 700837427H1 | SOYMON020 | g3021337 | BLASTN | 805 | 1e−58 | 86 |
| 1850 | 16 | 700753668H1 | SOYMON014 | g3021337 | BLASTN | 806 | 1e−58 | 85 |
| 1851 | 16 | 700667315H1 | SOYMON006 | g3021337 | BLASTN | 809 | 1e−58 | 81 |
| 1852 | 16 | 700808315H1 | SOYMON024 | g3021337 | BLASTN | 558 | 1e−57 | 80 |
| 1853 | 16 | 700670207H1 | SOYMON006 | g3021337 | BLASTN | 791 | 1e−57 | 87 |
| 1854 | 16 | 700849886H1 | SOYMON021 | g3021337 | BLASTN | 791 | 1e−57 | 83 |
| 1855 | 16 | 700839033H1 | SOYMON020 | g3021337 | BLASTN | 791 | 1e−57 | 81 |
| 1856 | 16 | 700751117H1 | SOYMON014 | g3021337 | BLASTN | 799 | 1e−57 | 86 |
| 1857 | 16 | 700851803H1 | SOYMON023 | g3021337 | BLASTN | 799 | 1e−57 | 86 |
| 1858 | 16 | 700669164H1 | SOYMON006 | g3021337 | BLASTN | 800 | 1e−57 | 80 |
| 1859 | 16 | 700548285H1 | SOYMON002 | g3021337 | BLASTN | 801 | 1e−57 | 85 |
| 1860 | 16 | 701065620H1 | SOYMON034 | g3021337 | BLASTN | 426 | 1e−56 | 82 |
| 1861 | 16 | 700727996H1 | SOYMON009 | g3021337 | BLASTN | 468 | 1e−56 | 79 |
| 1862 | 16 | 700869176H1 | SOYMON016 | g3021337 | BLASTN | 786 | 1e−56 | 85 |
| 1863 | 16 | 700973141H1 | SOYMON005 | g3021337 | BLASTN | 440 | 1e−55 | 79 |
| 1864 | 16 | 700969555H1 | SOYMON005 | g3021337 | BLASTN | 448 | 1e−55 | 81 |
| 1865 | 16 | 700866138H1 | SOYMON016 | g3021337 | BLASTN | 641 | 1e−55 | 86 |
| 1866 | 16 | 700904813H1 | SOYMON022 | g3021337 | BLASTN | 699 | 1e−55 | 85 |
| 1867 | 16 | 700894146H1 | SOYMON024 | g3021337 | BLASTN | 773 | 1e−55 | 86 |
| 1868 | 16 | 700669945H1 | SOYMON006 | g3021337 | BLASTN | 773 | 1e−55 | 86 |
| 1869 | 16 | 701060489H1 | SOYMON033 | g3021337 | BLASTN | 664 | 1e−54 | 85 |
| 1870 | 16 | 701125675H1 | SOYMON037 | g3021337 | BLASTN | 721 | 1e−54 | 85 |
| 1871 | 16 | 700754750H1 | SOYMON014 | g3021337 | BLASTN | 722 | 1e−54 | 86 |
| 1872 | 16 | 701142770H1 | SOYMON038 | g3021337 | BLASTN | 755 | 1e−54 | 88 |
| 1873 | 16 | 700731095H1 | SOYMON009 | g3021337 | BLASTN | 755 | 1e−54 | 87 |
| 1874 | 16 | 700667966H1 | SOYMON006 | g3021337 | BLASTN | 756 | 1e−54 | 84 |
| 1875 | 16 | 700673606H1 | SOYMON007 | g3021337 | BLASTN | 760 | 1e−54 | 83 |
| 1876 | 16 | 700605289H2 | SOYMON003 | g3021337 | BLASTN | 763 | 1e−54 | 84 |
| 1877 | 16 | 700965253H1 | SOYMON022 | g3021337 | BLASTN | 763 | 1e−54 | 86 |
| 1878 | 16 | 700732985H1 | SOYMON010 | g3021337 | BLASTN | 765 | 1e−54 | 87 |
| 1879 | 16 | 700986523H1 | SOYMON009 | g3021337 | BLASTN | 474 | 1e−53 | 85 |
| 1880 | 16 | 701100040H2 | SOYMON028 | g3021337 | BLASTN | 602 | 1e−53 | 85 |
| 1881 | 16 | 700895328H1 | SOYMON027 | g3021337 | BLASTN | 742 | 1e−53 | 83 |
| 1882 | 16 | 701141083H1 | SOYMON038 | g3021337 | BLASTN | 751 | 1e−53 | 85 |
| 1883 | 16 | 700829878H1 | SOYMON019 | g3021337 | BLASTN | 417 | 1e−52 | 86 |
| 1884 | 16 | 700671825H1 | SOYMON006 | g3021337 | BLASTN | 431 | 1e−52 | 79 |
| 1885 | 16 | 700755240H1 | SOYMON014 | g3021337 | BLASTN | 731 | 1e−52 | 88 |
| 1886 | 16 | 701011659H1 | SOYMON019 | g3021337 | BLASTN | 734 | 1e−52 | 86 |
| 1887 | 16 | 701011547H1 | SOYMON019 | g3021337 | BLASTN | 381 | 1e−51 | 84 |
| 1888 | 16 | 700835614H1 | SOYMON019 | g3021337 | BLASTN | 437 | 1e−51 | 80 |
| 1889 | 16 | 700671849H1 | SOYMON006 | g3021337 | BLASTN | 471 | 1e−51 | 87 |
| 1890 | 16 | 700734822H1 | SOYMON010 | g3021337 | BLASTN | 486 | 1e−51 | 79 |
| 1891 | 16 | 700830223H1 | SOYMON019 | g3021337 | BLASTN | 622 | 1e−51 | 84 |
| 1892 | 16 | 700659970H1 | SOYMON004 | g3021337 | BLASTN | 722 | 1e−51 | 82 |
| 1893 | 16 | 701101779H1 | SOYMON028 | g3021337 | BLASTN | 728 | 1e−51 | 86 |
| 1894 | 16 | 700852553H1 | SOYMON023 | g3021337 | BLASTN | 490 | 1e−50 | 88 |
| 1895 | 16 | 700853857H1 | SOYMON023 | g3021337 | BLASTN | 711 | 1e−50 | 88 |
| 1896 | 16 | 700980358H1 | SOYMON009 | g3021337 | BLASTN | 712 | 1e−50 | 85 |
| 1897 | 16 | 700672182H1 | SOYMON006 | g3021337 | BLASTN | 714 | 1e−50 | 89 |
| 1898 | 16 | 700748455H1 | SOYMON013 | g3021337 | BLASTN | 396 | 1e−49 | 85 |
| 1899 | 16 | 700657257H1 | SOYMON004 | g3021337 | BLASTN | 694 | 1e−49 | 75 |
| 1900 | 16 | 700729301H1 | SOYMON009 | g3021337 | BLASTN | 702 | 1e−49 | 80 |
| 1901 | 16 | 700726175H1 | SOYMON009 | g3021337 | BLASTN | 704 | 1e−49 | 80 |
| 1902 | 16 | 700966844H1 | SOYMON028 | g3021337 | BLASTN | 414 | 1e−47 | 81 |
| 1903 | 16 | 700960965H1 | SOYMON022 | g3021337 | BLASTN | 452 | 1e−47 | 85 |
| 1904 | 16 | 700678326H1 | SOYMON007 | g3021337 | BLASTN | 480 | 1e−47 | 83 |
| 1905 | 16 | 700751042H1 | SOYMON014 | g3021337 | BLASTN | 675 | 1e−47 | 87 |
| 1906 | 16 | 700830863H1 | SOYMON019 | g3021337 | BLASTN | 343 | 1e−46 | 84 |
| 1907 | 16 | 701213640H1 | SOYMON035 | g3021337 | BLASTN | 667 | 1e−46 | 87 |
| 1908 | 16 | 700870215H1 | SOYMON016 | g3021337 | BLASTN | 667 | 1e−46 | 80 |
| 1909 | 16 | 700658278H1 | SOYMON004 | g3021337 | BLASTN | 425 | 1e−44 | 87 |
| 1910 | 16 | 700942532H1 | SOYMON024 | g3021337 | BLASTN | 583 | 1e−44 | 83 |
| 1911 | 16 | 700986276H1 | SOYMON009 | g3021337 | BLASTN | 630 | 1e−43 | 81 |
| 1912 | 16 | 700870216H1 | SOYMON016 | g3021337 | BLASTN | 457 | 1e−42 | 82 |
| 1913 | 16 | 700899828H1 | SOYMON027 | g3021337 | BLASTN | 464 | 1e−42 | 83 |
| 1914 | 16 | 700678816H1 | SOYMON007 | g3021337 | BLASTN | 618 | 1e−42 | 86 |
| 1915 | 16 | 700666809H1 | SOYMON005 | g3021337 | BLASTN | 621 | 1e−42 | 82 |
| 1916 | 16 | 701098073H1 | SOYMON028 | g3021337 | BLASTN | 285 | 1e−41 | 83 |
| 1917 | 16 | 700669492H1 | SOYMON006 | g3021337 | BLASTN | 504 | 1e−39 | 83 |
| 1918 | 16 | 700975340H1 | SOYMON009 | g3021337 | BLASTN | 574 | 1e−39 | 81 |

TABLE A*-continued

| Seq No. | Cluster ID | CloneID | Library | NCBI gi | Method | Score | P-value | % Ident |
|---|---|---|---|---|---|---|---|---|
| 1919 | 16 | 700753528H1 | SOYMON014 | g3021337 | BLASTN | 576 | 1e-39 | 81 |
| 1920 | 16 | 700665923H1 | SOYMON005 | g3021337 | BLASTN | 373 | 1e-35 | 84 |
| 1921 | 16 | 701038320H1 | SOYMON029 | g3021337 | BLASTN | 518 | 1e-34 | 84 |
| 1922 | 16 | 700755605H1 | SOYMON014 | g3021337 | BLASTN | 431 | 1e-33 | 81 |
| 1923 | 16 | 700890349H1 | SOYMON024 | g3021337 | BLASTN | 511 | 1e-33 | 88 |
| 1924 | 16 | 700669817H1 | SOYMON006 | g3021337 | BLASTN | 363 | 1e-31 | 87 |
| 1925 | 16 | 701097640H1 | SOYMON028 | g3021337 | BLASTN | 476 | 1e-30 | 67 |
| 1926 | 16 | 700562959H1 | SOYMON002 | g3021337 | BLASTN | 482 | 1e-30 | 81 |
| 1927 | 16 | 700852454H1 | SOYMON023 | g3021337 | BLASTN | 446 | 1e-28 | 77 |
| 1928 | 16 | 701121443H1 | SOYMON037 | g3021337 | BLASTN | 418 | 1e-24 | 84 |
| 1929 | 16 | 701118247H1 | SOYMON037 | g3021337 | BLASTN | 280 | 1e-18 | 85 |
| 1930 | 16 | 700665401H1 | SOYMON005 | g927505 | BLASTX | 172 | 1e-16 | 94 |
| 1931 | 16 | 700750038H1 | SOYMON013 | g3021338 | BLASTX | 162 | 1e-15 | 84 |
| 1932 | 16 | 700665414H1 | SOYMON005 | g3021337 | BLASTN | 273 | 1e-13 | 88 |
| 1933 | 16 | 700889072H1 | SOYMON024 | g3021338 | BLASTX | 136 | 1e-11 | 83 |
| 1934 | 16 | 700727964H1 | SOYMON009 | g927505 | BLASTX | 137 | 1e-11 | 86 |
| 1935 | 16 | 700680648H1 | SOYMON008 | g3021337 | BLASTN | 226 | 1e-10 | 73 |
| 1936 | 16 | 701044547H1 | SOYMON032 | g927505 | BLASTX | 91 | 1e-9 | 76 |
| 1937 | 16 | 700649174H1 | SOYMON003 | g3021338 | BLASTX | 126 | 1e-9 | 83 |
| 1938 | 16531 | 701120682H1 | SOYMON037 | g3021337 | BLASTN | 716 | 1e-50 | 77 |
| 1939 | 1701 | 700993909H1 | SOYMON011 | g22633 | BLASTX | 112 | 1e-31 | 78 |
| 1940 | 1701 | 700955490H1 | SOYMON022 | g22633 | BLASTX | 176 | 1e-25 | 70 |
| 1941 | 1701 | 700682081H1 | SOYMON008 | g22633 | BLASTX | 147 | 1e-20 | 68 |
| 1942 | 1701 | 700988843H1 | SOYMON011 | g22633 | BLASTX | 90 | 1e-14 | 67 |
| 1943 | 1701 | 700740531H1 | SOYMON012 | g22633 | BLASTX | 92 | 1e-12 | 64 |
| 1944 | 1701 | 700790059H2 | SOYMON011 | g22633 | BLASTX | 92 | 1e-12 | 67 |
| 1945 | 1701 | 700872670H1 | SOYMON018 | g169037 | BLASTX | 144 | 1e-12 | 90 |
| 1946 | 1701 | 700990591H1 | SOYMON011 | g22632 | BLASTN | 199 | 1e-11 | 68 |
| 1947 | 1701 | 700743120H1 | SOYMON012 | g22633 | BLASTX | 92 | 1e-9 | 68 |
| 1948 | 1701 | 700994931H1 | SOYMON011 | g22633 | BLASTX | 92 | 1e-8 | 64 |
| 1949 | 1938 | 700738074H1 | SOYMON012 | g927507 | BLASTX | 134 | 1e-11 | 90 |
| 1950 | 239 | 701126904H1 | SOYMON037 | g169037 | BLASTX | 231 | 1e-24 | 81 |
| 1951 | 239 | 700668532H1 | SOYMON006 | g169037 | BLASTX | 202 | 1e-20 | 83 |
| 1952 | 239 | 700943660H1 | SOYMON024 | g169037 | BLASTX | 180 | 1e-17 | 84 |
| 1953 | 239 | 701009915H2 | SOYMON019 | g169037 | BLASTX | 180 | 1e-17 | 84 |
| 1954 | 239 | 701100047H2 | SOYMON028 | g169037 | BLASTX | 160 | 1e-15 | 84 |
| 1955 | 239 | 700794458H1 | SOYMON017 | g22633 | BLASTX | 131 | 1e-10 | 58 |
| 1956 | 239 | 700738441H1 | SOYMON012 | g169037 | BLASTX | 118 | 1e-8 | 78 |
| 1957 | 3425 | 700984050H1 | SOYMON009 | g3021337 | BLASTN | 874 | 1e-64 | 80 |
| 1958 | 3425 | 701014509H1 | SOYMON019 | g3021337 | BLASTN | 520 | 1e-60 | 80 |
| 1959 | 3425 | 701138819H1 | SOYMON038 | g3021337 | BLASTN | 815 | 1e-59 | 80 |
| 1960 | 3425 | 700977309H1 | SOYMON009 | g3021337 | BLASTN | 809 | 1e-58 | 80 |
| 1961 | 3425 | 700984876H1 | SOYMON009 | g3021337 | BLASTN | 813 | 1e-58 | 80 |
| 1962 | 3425 | 701046151H1 | SOYMON032 | g3021337 | BLASTN | 730 | 1e-52 | 80 |
| 1963 | 3425 | 700889668H1 | SOYMON024 | g3021337 | BLASTN | 737 | 1e-52 | 81 |
| 1964 | 3425 | 700976571H1 | SOYMON009 | g3021337 | BLASTN | 737 | 1e-52 | 81 |
| 1965 | 3425 | 701045371H1 | SOYMON032 | g3021337 | BLASTN | 716 | 1e-50 | 79 |
| 1966 | 3425 | 700548283H1 | SOYMON002 | g3021337 | BLASTN | 700 | 1e-49 | 81 |
| 1967 | 3425 | 701103461H1 | SOYMON028 | g3021337 | BLASTN | 705 | 1e-49 | 81 |
| 1968 | 3425 | 700898446H1 | SOYMON027 | g3021337 | BLASTN | 686 | 1e-48 | 83 |
| 1969 | 3425 | 701006432H1 | SOYMON019 | g3021337 | BLASTN | 688 | 1e-48 | 83 |
| 1970 | 3425 | 701041476H1 | SOYMON029 | g3021337 | BLASTN | 693 | 1e-48 | 81 |
| 1971 | 3425 | 700568335H1 | SOYMON002 | g3021337 | BLASTN | 678 | 1e-47 | 82 |
| 1972 | 3425 | 701046312H1 | SOYMON032 | g3021337 | BLASTN | 650 | 1e-45 | 85 |
| 1973 | 3425 | 701050171H1 | SOYMON032 | g3021337 | BLASTN | 650 | 1e-45 | 85 |
| 1974 | 3425 | 700685063H1 | SOYMON008 | g3021337 | BLASTN | 643 | 1e-44 | 83 |
| 1975 | 3425 | 701010250H2 | SOYMON019 | g3021337 | BLASTN | 542 | 1e-36 | 86 |
| 1976 | 3425 | 700665454H1 | SOYMON005 | g3021337 | BLASTN | 520 | 1e-34 | 80 |
| 1977 | 3425 | 701043888H1 | SOYMON032 | g3021337 | BLASTN | 495 | 1e-32 | 85 |
| 1978 | 3425 | 700726806H1 | SOYMON009 | g3021337 | BLASTN | 213 | 1e-23 | 76 |
| 1979 | 491 | 700997879H1 | SOYMON018 | g22632 | BLASTN | 789 | 1e-56 | 77 |
| 1980 | 491 | 700646208H1 | SOYMON012 | g22632 | BLASTN | 733 | 1e-52 | 76 |
| 1981 | 491 | 700559796H1 | SOYMON001 | g22632 | BLASTN | 715 | 1e-50 | 76 |
| 1982 | 491 | 700789784H1 | SOYMON011 | g22632 | BLASTN | 664 | 1e-46 | 76 |
| 1983 | 491 | 700683122H1 | SOYMON008 | g22632 | BLASTN | 485 | 1e-41 | 86 |
| 1984 | 491 | 701105914H1 | SOYMON036 | g22632 | BLASTN | 504 | 1e-41 | 73 |
| 1985 | 491 | 700558789H1 | SOYMON001 | g22632 | BLASTN | 607 | 1e-41 | 74 |
| 1986 | 491 | 700873051H1 | SOYMON018 | g22632 | BLASTN | 608 | 1e-41 | 75 |
| 1987 | 491 | 700684010H1 | SOYMON008 | g22632 | BLASTN | 597 | 1e-40 | 75 |
| 1988 | 491 | 700786096H2 | SOYMON011 | g22632 | BLASTN | 576 | 1e-39 | 75 |
| 1989 | 491 | 700731865H1 | SOYMON010 | g22632 | BLASTN | 582 | 1e-39 | 75 |
| 1990 | 491 | 701108111H1 | SOYMON036 | g22632 | BLASTN | 467 | 1e-38 | 75 |
| 1991 | 491 | 700740887H1 | SOYMON012 | g22632 | BLASTN | 567 | 1e-38 | 74 |
| 1992 | 491 | 700559579H1 | SOYMON001 | g22632 | BLASTN | 572 | 1e-38 | 75 |
| 1993 | 491 | 700996104H1 | SOYMON018 | g22632 | BLASTN | 476 | 1e-37 | 76 |
| 1994 | 491 | 700682145H1 | SOYMON008 | g22632 | BLASTN | 542 | 1e-36 | 74 |
| 1995 | 491 | 700737263H1 | SOYMON010 | g22632 | BLASTN | 526 | 1e-35 | 74 |

TABLE A*-continued

| Seq No. | Cluster ID | CloneID | Library | NCBI gi | Method | Score | P-value | % Ident |
|---|---|---|---|---|---|---|---|---|
| 1996 | 491 | 700547963H1 | SOYMON001 | g22632 | BLASTN | 527 | 1e-35 | 73 |
| 1997 | 491 | 700686296H1 | SOYMON008 | g22632 | BLASTN | 527 | 1e-35 | 73 |
| 1998 | 491 | 700646072H1 | SOYMON011 | g22632 | BLASTN | 537 | 1e-35 | 74 |
| 1999 | 491 | 701106662H1 | SOYMON036 | g22632 | BLASTN | 514 | 1e-34 | 74 |
| 2000 | 491 | 700684335H1 | SOYMON008 | g22632 | BLASTN | 516 | 1e-34 | 74 |
| 2001 | 491 | 701000609H1 | SOYMON018 | g22632 | BLASTN | 520 | 1e-34 | 74 |
| 2002 | 491 | 700685658H1 | SOYMON008 | g22632 | BLASTN | 520 | 1e-34 | 74 |
| 2003 | 491 | 700875532H1 | SOYMON018 | g22632 | BLASTN | 521 | 1e-34 | 73 |
| 2004 | 491 | 700730264H1 | SOYMON009 | g22632 | BLASTN | 502 | 1e-33 | 74 |
| 2005 | 491 | 700872948H1 | SOYMON018 | g22632 | BLASTN | 502 | 1e-33 | 74 |
| 2006 | 491 | 700685813H1 | SOYMON008 | g22632 | BLASTN | 502 | 1e-33 | 74 |
| 2007 | 491 | 701104554H1 | SOYMON036 | g22632 | BLASTN | 503 | 1e-33 | 74 |
| 2008 | 491 | 700960601H1 | SOYMON022 | g22632 | BLASTN | 503 | 1e-33 | 74 |
| 2009 | 491 | 700876633H1 | SOYMON018 | g22632 | BLASTN | 503 | 1e-33 | 74 |
| 2010 | 491 | 700739662H1 | SOYMON012 | g22632 | BLASTN | 504 | 1e-33 | 72 |
| 2011 | 491 | 700685904H1 | SOYMON008 | g22632 | BLASTN | 505 | 1e-33 | 72 |
| 2012 | 491 | 700995183H1 | SOYMON011 | g22632 | BLASTN | 513 | 1e-33 | 73 |
| 2013 | 491 | 700901996H1 | SOYMON027 | g22632 | BLASTN | 513 | 1e-33 | 74 |
| 2014 | 491 | 700727070H1 | SOYMON009 | g22632 | BLASTN | 490 | 1e-32 | 72 |
| 2015 | 491 | 700685790H1 | SOYMON008 | g22632 | BLASTN | 492 | 1e-32 | 74 |
| 2016 | 491 | 700998652H1 | SOYMON018 | g22632 | BLASTN | 494 | 1e-32 | 72 |
| 2017 | 491 | 700740465H1 | SOYMON012 | g22632 | BLASTN | 482 | 1e-31 | 74 |
| 2018 | 491 | 700682621H2 | SOYMON008 | g22632 | BLASTN | 484 | 1e-31 | 74 |
| 2019 | 491 | 700874316H1 | SOYMON018 | g22632 | BLASTN | 466 | 1e-30 | 73 |
| 2020 | 491 | 700686477H1 | SOYMON008 | g22632 | BLASTN | 473 | 1e-30 | 73 |
| 2021 | 491 | 700739979H1 | SOYMON012 | g22632 | BLASTN | 476 | 1e-30 | 74 |
| 2022 | 491 | 700739416H1 | SOYMON012 | g22632 | BLASTN | 476 | 1e-30 | 74 |
| 2023 | 491 | 700685976H1 | SOYMON008 | g22632 | BLASTN | 476 | 1e-30 | 74 |
| 2024 | 491 | 700739629H1 | SOYMON012 | g22632 | BLASTN | 486 | 1e-30 | 70 |
| 2025 | 491 | 700989163H1 | SOYMON011 | g22632 | BLASTN | 468 | 1e-29 | 72 |
| 2026 | 491 | 701000555H1 | SOYMON018 | g22632 | BLASTN | 477 | 1e-29 | 72 |
| 2027 | 491 | 700872702H1 | SOYMON018 | g22632 | BLASTN | 436 | 1e-28 | 72 |
| 2028 | 491 | 701000781H1 | SOYMON018 | g22632 | BLASTN | 460 | 1e-28 | 73 |
| 2029 | 491 | 700682760H1 | SOYMON008 | g22632 | BLASTN | 463 | 1e-28 | 72 |
| 2030 | 491 | 700740390H1 | SOYMON012 | g22632 | BLASTN | 440 | 1e-27 | 73 |
| 2031 | 491 | 700685346H1 | SOYMON008 | g22632 | BLASTN | 451 | 1e-27 | 72 |
| 2032 | 491 | 700557272H1 | SOYMON001 | g22632 | BLASTN | 250 | 1e-26 | 78 |
| 2033 | 491 | 700953343H1 | SOYMON022 | g22632 | BLASTN | 349 | 1e-26 | 74 |
| 2034 | 491 | 700741960H1 | SOYMON012 | g22632 | BLASTN | 430 | 1e-26 | 73 |
| 2035 | 491 | 700680247H2 | SOYMON008 | g22632 | BLASTN | 425 | 1e-25 | 67 |
| 2036 | 491 | 700680002H2 | SOYMON008 | g22632 | BLASTN | 241 | 1e-24 | 72 |
| 2037 | 491 | 700684827H1 | SOYMON008 | g22632 | BLASTN | 379 | 1e-24 | 74 |
| 2038 | 491 | 700956353H1 | SOYMON022 | g22632 | BLASTN | 410 | 1e-24 | 72 |
| 2039 | 491 | 700787513H1 | SOYMON011 | g22632 | BLASTN | 235 | 1e-22 | 72 |
| 2040 | 491 | 700725070H1 | SOYMON009 | g22632 | BLASTN | 241 | 1e-22 | 71 |
| 2041 | 491 | 700741111H1 | SOYMON012 | g22632 | BLASTN | 304 | 1e-22 | 73 |
| 2042 | 491 | 700985308H1 | SOYMON009 | g22632 | BLASTN | 241 | 1e-21 | 80 |
| 2043 | 491 | 700738230H1 | SOYMON012 | g22632 | BLASTN | 241 | 1e-21 | 72 |
| 2044 | 491 | 700991396H1 | SOYMON011 | g22632 | BLASTN | 350 | 1e-21 | 72 |
| 2045 | 491 | 700741276H1 | SOYMON012 | g22632 | BLASTN | 379 | 1e-21 | 71 |
| 2046 | 491 | 700740223H1 | SOYMON012 | g22632 | BLASTN | 241 | 1e-20 | 72 |
| 2047 | 491 | 700738808H1 | SOYMON012 | g22632 | BLASTN | 241 | 1e-20 | 72 |
| 2048 | 491 | 700997995H1 | SOYMON018 | g22632 | BLASTN | 241 | 1e-19 | 81 |
| 2049 | 491 | 700875139H1 | SOYMON018 | g22632 | BLASTN | 241 | 1e-19 | 71 |
| 2050 | 491 | 700989713H1 | SOYMON011 | g22632 | BLASTN | 241 | 1e-19 | 73 |
| 2051 | 491 | 700958366H1 | SOYMON022 | g22632 | BLASTN | 241 | 1e-18 | 71 |
| 2052 | 491 | 700683887H1 | SOYMON008 | g22632 | BLASTN | 344 | 1e-18 | 70 |
| 2053 | 491 | 700740788H1 | SOYMON012 | g22632 | BLASTN | 339 | 1e-17 | 70 |
| 2054 | 491 | 700743058H1 | SOYMON012 | g22632 | BLASTN | 205 | 1e-16 | 81 |
| 2055 | 491 | 700996423H1 | SOYMON018 | g22632 | BLASTN | 234 | 1e-16 | 80 |
| 2056 | 491 | 700686075H1 | SOYMON008 | g22632 | BLASTN | 241 | 1e-16 | 71 |
| 2057 | 491 | 700738811H1 | SOYMON012 | g22632 | BLASTN | 193 | 1e-15 | 72 |
| 2058 | 491 | 700998312H1 | SOYMON018 | g22632 | BLASTN | 234 | 1e-15 | 73 |
| 2059 | 491 | 700681825H1 | SOYMON008 | g22632 | BLASTN | 241 | 1e-15 | 81 |
| 2060 | 491 | 701109105H1 | SOYMON036 | g22632 | BLASTN | 290 | 1e-14 | 69 |
| 2061 | 491 | 701203741H2 | SOYMON035 | g22632 | BLASTN | 230 | 1e-13 | 78 |
| 2062 | 491 | 700740785H1 | SOYMON012 | g22632 | BLASTN | 287 | 1e-13 | 68 |
| 2063 | 491 | 700738486H1 | SOYMON012 | g22632 | BLASTN | 295 | 1e-13 | 64 |
| 2064 | 491 | 700739078H1 | SOYMON012 | g22632 | BLASTN | 178 | 1e-12 | 73 |
| 2065 | 491 | 701002287H1 | SOYMON018 | g22632 | BLASTN | 255 | 1e-12 | 74 |
| 2066 | 491 | 700742470H1 | SOYMON012 | g22632 | BLASTN | 278 | 1e-12 | 69 |
| 2067 | 491 | 700743421H1 | SOYMON012 | g22632 | BLASTN | 261 | 1e-11 | 71 |
| 2068 | 491 | 700744039H1 | SOYMON012 | g22632 | BLASTN | 265 | 1e-11 | 69 |
| 2069 | 491 | 700789444H2 | SOYMON011 | g22632 | BLASTN | 158 | 1e-10 | 87 |
| 2070 | 491 | 700741074H1 | SOYMON012 | g22632 | BLASTN | 178 | 1e-10 | 77 |
| 2071 | 491 | 700998877H1 | SOYMON018 | g22632 | BLASTN | 235 | 1e-10 | 72 |
| 2072 | 491 | 700740005H1 | SOYMON012 | g22633 | BLASTX | 75 | 1e-9 | 64 |

TABLE A*-continued

| Seq No. | Cluster ID | CloneID | Library | NCBI gi | Method | Score | P-value | % Ident |
|---|---|---|---|---|---|---|---|---|
| 2073 | 491 | 700872703H1 | SOYMON018 | g169037 | BLASTX | 116 | 1e−9 | 83 |
| 2074 | 491 | 700743301H1 | SOYMON012 | g22632 | BLASTN | 241 | 1e−9 | 76 |
| 2075 | 491 | 700875039H1 | SOYMON018 | g22632 | BLASTN | 241 | 1e−9 | 72 |
| 2076 | 491 | 700742515H1 | SOYMON012 | g22632 | BLASTN | 241 | 1e−9 | 76 |
| 2077 | 491 | 700990557H1 | SOYMON011 | g22632 | BLASTN | 241 | 1e−9 | 76 |
| 2078 | 491 | 700743995H1 | SOYMON012 | g22632 | BLASTN | 241 | 1e−9 | 76 |
| 2079 | 491 | 700743495H1 | SOYMON012 | g22632 | BLASTN | 241 | 1e−9 | 76 |
| 2080 | 491 | 701001909H1 | SOYMON018 | g22632 | BLASTN | 241 | 1e−9 | 76 |
| 2081 | 491 | 701001445H1 | SOYMON018 | g169037 | BLASTX | 115 | 1e−8 | 92 |
| 2082 | 491 | 700554881H1 | SOYMON001 | g169037 | BLASTX | 116 | 1e−8 | 94 |
| 2083 | 491 | 700954194H1 | SOYMON022 | g169037 | BLASTX | 116 | 1e−8 | 94 |
| 2084 | 491 | 700996869H1 | SOYMON018 | g22632 | BLASTN | 230 | 1e−8 | 76 |
| 2085 | 491 | 700897820H1 | SOYMON027 | g22632 | BLASTN | 234 | 1e−8 | 74 |
| 2086 | 491 | 700742574H1 | SOYMON012 | g22632 | BLASTN | 234 | 1e−8 | 74 |
| 2087 | 491 | 700684738H1 | SOYMON008 | g22632 | BLASTN | 235 | 1e−8 | 75 |
| 2088 | 7368 | 700739343H1 | SOYMON012 | g927507 | BLASTX | 164 | 1e−15 | 88 |
| 2089 | −GM32379 | LIB3051-015-Q1-E1-B12 | LIB3051 | g3021337 | BLASTN | 260 | 1e−28 | 77 |
| 2090 | −GM8265 | LIB3039-048-Q1-E1-F11 | LIB3039 | g3021337 | BLASTN | 481 | 1e−29 | 65 |
| 2091 | 16 | LIB3027-010-Q1-B1-B7 | LIB3027 | g3021337 | BLASTN | 1393 | 1e−107 | 82 |
| 2092 | 16 | LIB3039-049-Q1-E1-B8 | LIB3039 | g3021337 | BLASTN | 1297 | 1e−99 | 83 |
| 2093 | 16 | LIB3051-061-Q1-K1-E11 | LIB3051 | g3021337 | BLASTN | 1303 | 1e−99 | 84 |
| 2094 | 16 | LIB3056-009-Q1-N1-A10 | LIB3056 | g3021337 | BLASTN | 1126 | 1e−96 | 84 |
| 2095 | 16 | LIB3051-025-Q1-K1-E11 | LIB3051 | g3021337 | BLASTN | 1262 | 1e−96 | 83 |
| 2096 | 16 | LIB3056-014-Q1-N1-E1 | LIB3056 | g3021337 | BLASTN | 1077 | 1e−94 | 81 |
| 2097 | 16 | LIB3055-005-Q1-N1-A8 | LIB3055 | g3021337 | BLASTN | 1227 | 1e−93 | 84 |
| 2098 | 16 | LIB3040-045-Q1-E1-A4 | LIB3040 | g3021337 | BLASTN | 1211 | 1e−92 | 83 |
| 2099 | 16 | LIB3028-010-Q1-B1-G9 | LIB3028 | g3021337 | BLASTN | 1215 | 1e−92 | 83 |
| 2100 | 16 | LIB3056-010-Q1-N1-G8 | LIB3056 | g3021337 | BLASTN | 1217 | 1e−92 | 84 |
| 2101 | 16 | LIB3039-029-Q1-E1-A6 | LIB3039 | g3021337 | BLASTN | 1128 | 1e−85 | 85 |
| 2102 | 16 | LIB3051-014-Q1-E1-D2 | LIB3051 | g3021337 | BLASTN | 716 | 1e−80 | 83 |
| 2103 | 16 | LIB3030-010-Q1-B1-D7 | LIB3030 | g3021337 | BLASTN | 1052 | 1e−78 | 83 |
| 2104 | 16 | LIB3051-094-Q1-K1-A9 | LIB3051 | g3021337 | BLASTN | 778 | 1e−74 | 83 |
| 2105 | 16 | LIB3028-030-Q1-B1-C9 | LIB3028 | g3021337 | BLASTN | 953 | 1e−70 | 85 |
| 2106 | 16 | LIB3052-004-Q1-N1-D8 | LIB3052 | g3021337 | BLASTN | 868 | 1e−63 | 82 |
| 2107 | 16 | LIB3065-014-Q1-N1-A3 | LIB3065 | g3021337 | BLASTN | 540 | 1e−61 | 79 |
| 2108 | 16 | LIB3050-019-Q1-K1-H1 | LIB3050 | g168420 | BLASTX | 223 | 1e−40 | 63 |
| 2109 | 16 | LIB3051-062-Q1-K1-B5 | LIB3051 | g3021337 | BLASTN | 541 | 1e−38 | 79 |
| 2110 | 3425 | LIB3051-067-Q1-K1-E7 | LIB3051 | g3021337 | BLASTN | 1082 | 1e−81 | 78 |
| 2111 | 3425 | LIB3050-006-Q1-E1-G7 | LIB3050 | g3021337 | BLASTN | 752 | 1e−57 | 75 |
| 2112 | 491 | LIB3028-011-Q1-B1-B9 | LIB3028 | g22632 | BLASTN | 911 | 1e−67 | 75 |
| 2113 | 491 | LIB3028-011-Q1-B1-F2 | LIB3028 | g22632 | BLASTN | 886 | 1e−65 | 77 |
| SOYBEAN FRUCTOSE-1,6-BISPHOSPHATASE | | | | | | | | |
| 2114 | −700685384 | 700685384H1 | SOYMON008 | g21244 | BLASTN | 597 | 1e−49 | 80 |
| 2115 | −700737915 | 700737915H1 | SOYMON012 | g515746 | BLASTN | 1316 | 1e−100 | 97 |
| 2116 | −700741457 | 700741457H1 | SOYMON012 | g3041774 | BLASTN | 692 | 1e−58 | 80 |
| 2117 | −700874831 | 700874831H1 | SOYMON018 | g515746 | BLASTN | 1295 | 1e−99 | 100 |
| 2118 | −700996155 | 700996155H1 | SOYMON018 | g3041774 | BLASTN | 651 | 1e−45 | 83 |
| 2119 | −700996632 | 700996632H1 | SOYMON018 | g515746 | BLASTN | 507 | 1e−51 | 90 |
| 2120 | −700998027 | 700998027H1 | SOYMON018 | g515746 | BLASTN | 636 | 1e−65 | 94 |
| 2121 | −701209548 | 701209548H1 | SOYMON035 | g3041774 | BLASTN | 642 | 1e−44 | 83 |
| 2122 | 10129 | 700870828H1 | SOYMON018 | g21244 | BLASTN | 827 | 1e−60 | 79 |

TABLE A*-continued

| Seq No. | Cluster ID | CloneID | Library | NCBI gi | Method | Score | P-value | % Ident |
|---|---|---|---|---|---|---|---|---|
| 2123 | 10129 | 700741669H1 | SOYMON012 | g21244 | BLASTN | 657 | 1e−53 | 80 |
| 2124 | 10348 | 700555754H1 | SOYMON001 | g21244 | BLASTN | 466 | 1e−29 | 77 |
| 2125 | 10348 | 700991527H1 | SOYMON011 | g440591 | BLASTX | 169 | 1e−16 | 88 |
| 2126 | 13716 | 700898719H1 | SOYMON027 | g515746 | BLASTN | 1186 | 1e−90 | 97 |
| 2127 | 13716 | 700993540H1 | SOYMON011 | g515746 | BLASTN | 1179 | 1e−89 | 98 |
| 2128 | 13716 | 700909657H1 | SOYMON022 | g515746 | BLASTN | 568 | 1e−57 | 86 |
| 2129 | 1894 | 700555054H1 | SOYMON001 | g515746 | BLASTN | 1320 | 1e−101 | 100 |
| 2130 | 1894 | 700685264H1 | SOYMON008 | g515746 | BLASTN | 1323 | 1e−101 | 99 |
| 2131 | 1894 | 700558854H1 | SOYMON001 | g515746 | BLASTN | 695 | 1e−98 | 100 |
| 2132 | 1894 | 700554755H1 | SOYMON001 | g515746 | BLASTN | 767 | 1e−98 | 99 |
| 2133 | 1894 | 701000504H1 | SOYMON018 | g515746 | BLASTN | 626 | 1e−95 | 98 |
| 2134 | 1894 | 700738115H1 | SOYMON012 | g515746 | BLASTN | 1230 | 1e−93 | 100 |
| 2135 | 1894 | 700992933H1 | SOYMON011 | g515746 | BLASTN | 1074 | 1e−91 | 98 |
| 2136 | 1894 | 701107444H1 | SOYMON036 | g515746 | BLASTN | 1201 | 1e−91 | 99 |
| 2137 | 1894 | 700852823H1 | SOYMON023 | g515746 | BLASTN | 1041 | 1e−90 | 98 |
| 2138 | 1894 | 700733478H1 | SOYMON010 | g515746 | BLASTN | 1150 | 1e−90 | 97 |
| 2139 | 1894 | 701105185H1 | SOYMON036 | g515746 | BLASTN | 641 | 1e−87 | 89 |
| 2140 | 1894 | 700737830H1 | SOYMON012 | g515746 | BLASTN | 1060 | 1e−87 | 100 |
| 2141 | 1894 | 700685110H1 | SOYMON008 | g515746 | BLASTN | 597 | 1e−86 | 90 |
| 2142 | 1894 | 700968307H1 | SOYMON036 | g515746 | BLASTN | 1113 | 1e−84 | 97 |
| 2143 | 1894 | 700653014H1 | SOYMON003 | g515746 | BLASTN | 587 | 1e−82 | 90 |
| 2144 | 1894 | 700555504H1 | SOYMON001 | g515746 | BLASTN | 626 | 1e−81 | 88 |
| 2145 | 1894 | 700751540H1 | SOYMON014 | g515746 | BLASTN | 585 | 1e−77 | 91 |
| 2146 | 1894 | 700901976H1 | SOYMON027 | g515746 | BLASTN | 505 | 1e−73 | 87 |
| 2147 | 1894 | 700986496H1 | SOYMON009 | g515746 | BLASTN | 559 | 1e−73 | 90 |
| 2148 | 1894 | 700751580H1 | SOYMON014 | g515746 | BLASTN | 569 | 1e−72 | 89 |
| 2149 | 1894 | 700751532H1 | SOYMON014 | g515746 | BLASTN | 571 | 1e−72 | 90 |
| 2150 | 1894 | 700990937H1 | SOYMON011 | g515746 | BLASTN | 544 | 1e−71 | 88 |
| 2151 | 1894 | 700740789H1 | SOYMON012 | g515746 | BLASTN | 630 | 1e−69 | 100 |
| 2152 | 1894 | 700743994H1 | SOYMON012 | g515746 | BLASTN | 945 | 1e−69 | 100 |
| 2153 | 1894 | 700754374H1 | SOYMON014 | g515746 | BLASTN | 460 | 1e−62 | 91 |
| 2154 | 1894 | 701001295H1 | SOYMON018 | g515746 | BLASTN | 541 | 1e−62 | 97 |
| 2155 | 1894 | 701155952H1 | SOYMON031 | g515746 | BLASTN | 568 | 1e−51 | 83 |
| 2156 | 1894 | 700872212H1 | SOYMON018 | g515746 | BLASTN | 670 | 1e−47 | 100 |
| 2157 | 1894 | 700682196H1 | SOYMON008 | g515746 | BLASTN | 609 | 1e−41 | 98 |
| 2158 | 1894 | 700738779H1 | SOYMON012 | g515746 | BLASTN | 252 | 1e−16 | 82 |
| 2159 | 26568 | 700844816H1 | SOYMON021 | g21244 | BLASTN | 649 | 1e−45 | 78 |
| 2160 | 27512 | 701128049H1 | SOYMON037 | g440591 | BLASTX | 185 | 1e−18 | 87 |
| 2161 | 7128 | 700649846H1 | SOYMON003 | g440591 | BLASTX | 125 | 1e−15 | 81 |
| 2162 | 10348 | LIB3030-010-Q1-B1-C7 | LIB3030 | g21244 | BLASTN | 476 | 1e−28 | 76 |
| FRUCTOSE-6-PHOSPHATE,2-KINASE | | | | | | | | |
| 2163 | −700730441 | 700730441H1 | SOYMON009 | g3309583 | BLASTX | 179 | 1e−17 | 82 |
| 2164 | −700953509 | 700953509H1 | SOYMON022 | g3170229 | BLASTN | 674 | 1e−47 | 75 |
| 2165 | −700955121 | 700955121H1 | SOYMON022 | g3309582 | BLASTN | 303 | 1e−14 | 68 |
| 2166 | −GM28972 | LIB3050-012-Q1-E1-E9 | LIB3050 | g3170229 | BLASTN | 1073 | 1e−80 | 80 |
| SOYBEAN PHOSPHOGLUCOISOMERASE | | | | | | | | |
| 2167 | −700568558 | 700568558H1 | SOYMON002 | g1369950 | BLASTX | 165 | 1e−15 | 80 |
| 2168 | −700845275 | 700845275H1 | SOYMON021 | g1100771 | BLASTX | 124 | 1e−10 | 53 |
| 2169 | −700960755 | 700960755H1 | SOYMON022 | g1100771 | BLASTX | 153 | 1e−14 | 52 |
| 2170 | 18663 | 700838363H1 | SOYMON020 | g1100771 | BLASTX | 215 | 1e−22 | 63 |
| 2171 | 18663 | 700838355H1 | SOYMON020 | g1100771 | BLASTX | 155 | 1e−14 | 81 |
| 2172 | 19355 | 700897450H1 | SOYMON027 | g1100771 | BLASTX | 273 | 1e−31 | 74 |
| 2173 | 19355 | 700744258H1 | SOYMON013 | g1100771 | BLASTX | 207 | 1e−29 | 69 |
| 2174 | 19355 | 701153832H1 | SOYMON031 | g1100771 | BLASTX | 226 | 1e−23 | 58 |
| 2175 | 20088 | 700856114H1 | SOYMON023 | g1100771 | BLASTX | 176 | 1e−33 | 75 |
| 2176 | 20088 | 700670380H1 | SOYMON006 | g1100771 | BLASTX | 207 | 1e−33 | 71 |
| 2177 | 20088 | 700788785H2 | SOYMON011 | g1100771 | BLASTX | 120 | 1e−32 | 74 |
| 2178 | 20088 | 700847659H1 | SOYMON021 | g1100771 | BLASTX | 192 | 1e−31 | 84 |
| 2179 | 20088 | 701136417H1 | SOYMON038 | g1100771 | BLASTX | 169 | 1e−27 | 66 |
| 2180 | 31255 | 701207622H1 | SOYMON035 | g1100771 | BLASTX | 168 | 1e−29 | 61 |
| 2181 | 20088 | LIB3051-014-Q1-E1-G3 | LIB3051 | g1100771 | BLASTX | 400 | 1e−68 | 73 |
| 2182 | 31255 | LIB3056-008-Q1-N1-G8 | LIB3056 | g1100771 | BLASTX | 188 | 1e−52 | 62 |
| SOYBEAN VACUOLAR H+-TRANSLOCATING-PYROPHOSPHATASE | | | | | | | | |
| 2183 | −700660662 | 700660662H1 | SOYMON004 | g16347 | BLASTN | 540 | 1e−36 | 79 |
| 2184 | −700793860 | 700793860H1 | SOYMON017 | g2706449 | BLASTN | 808 | 1e−58 | 78 |
| 2185 | −700837007 | 700837007H1 | SOYMON020 | g16347 | BLASTN | 776 | 1e−55 | 78 |
| 2186 | −700890647 | 700890647H1 | SOYMON024 | g790474 | BLASTN | 826 | 1e−60 | 81 |
| 2187 | −700942978 | 700942978H1 | SOYMON024 | g790478 | BLASTN | 605 | 1e−63 | 82 |
| 2188 | −700944280 | 700944280H1 | SOYMON024 | g790479 | BLASTX | 119 | 1e−10 | 76 |
| 2189 | −700974544 | 700974544H1 | SOYMON005 | g1103711 | BLASTN | 854 | 1e−62 | 83 |

TABLE A*-continued

| Seq No. | Cluster ID | CloneID | Library | NCBI gi | Method | Score | P-value | % Ident |
|---|---|---|---|---|---|---|---|---|
| 2190 | −700984449 | 700984449H1 | SOYMON009 | g1103711 | BLASTN | 287 | 1e−12 | 71 |
| 2191 | −700989248 | 700989248H1 | SOYMON011 | g534915 | BLASTN | 276 | 1e−14 | 67 |
| 2192 | −701102931 | 701102931H1 | SOYMON028 | g2706449 | BLASTN | 438 | 1e−46 | 76 |
| 2193 | −701106870 | 701106870H1 | SOYMON036 | g790478 | BLASTN | 623 | 1e−47 | 75 |
| 2194 | −701122796 | 701122796H1 | SOYMON037 | g2258074 | BLASTX | 71 | 1e−15 | 73 |
| 2195 | −701132123 | 701132123H1 | SOYMON038 | g790478 | BLASTN | 627 | 1e−43 | 81 |
| 2196 | −701136557 | 701136557H1 | SOYMON038 | g16347 | BLASTN | 376 | 1e−33 | 77 |
| 2197 | 14021 | 700973215H1 | SOYMON005 | g2668745 | BLASTN | 435 | 1e−39 | 80 |
| 2198 | 14021 | 701109310H1 | SOYMON036 | g2668745 | BLASTN | 281 | 1e−25 | 83 |
| 2199 | 16 | 700891764H1 | SOYMON024 | g790479 | BLASTX | 172 | 1e−16 | 68 |
| 2200 | 19232 | 701061126H1 | SOYMON033 | g790474 | BLASTN | 935 | 1e−69 | 81 |
| 2201 | 19232 | 700962864H1 | SOYMON022 | g790474 | BLASTN | 874 | 1e−64 | 82 |
| 2202 | 20872 | 700754883H1 | SOYMON014 | g790478 | BLASTN | 824 | 1e−59 | 81 |
| 2203 | 20872 | 700971147H1 | SOYMON005 | g1103711 | BLASTN | 564 | 1e−54 | 79 |
| 2204 | 2813 | 700797861H1 | SOYMON017 | g16347 | BLASTN | 731 | 1e−52 | 79 |
| 2205 | 2813 | 700944850H1 | SOYMON024 | g2570500 | BLASTN | 738 | 1e−52 | 82 |
| 2206 | 2813 | 701056207H1 | SOYMON032 | g2570500 | BLASTN | 556 | 1e−46 | 80 |
| 2207 | 2813 | 700605115H2 | SOYMON003 | g2570500 | BLASTN | 478 | 1e−42 | 80 |
| 2208 | 2813 | 700897063H1 | SOYMON027 | g2570500 | BLASTN | 596 | 1e−40 | 80 |
| 2209 | 2813 | 700561829H1 | SOYMON002 | g2570500 | BLASTN | 570 | 1e−38 | 80 |
| 2210 | 2813 | 701204883H1 | SOYMON035 | g2668745 | BLASTN | 545 | 1e−36 | 77 |
| 2211 | 2813 | 700754984H1 | SOYMON014 | g2570500 | BLASTN | 527 | 1e−35 | 75 |
| 2212 | 2813 | 700854552H1 | SOYMON023 | g2570500 | BLASTN | 536 | 1e−35 | 79 |
| 2213 | 2813 | 700873337H1 | SOYMON018 | g2570500 | BLASTN | 505 | 1e−33 | 75 |
| 2214 | 2813 | 700873349H1 | SOYMON018 | g2570500 | BLASTN | 506 | 1e−33 | 75 |
| 2215 | 2813 | 700954403H1 | SOYMON022 | g2668745 | BLASTN | 499 | 1e−32 | 76 |
| 2216 | 2813 | 700846561H1 | SOYMON021 | g2570500 | BLASTN | 488 | 1e−31 | 75 |
| 2217 | 2813 | 700953987H1 | SOYMON022 | g2570500 | BLASTN | 461 | 1e−29 | 75 |
| 2218 | 2813 | 700568667H1 | SOYMON002 | g2570500 | BLASTN | 296 | 1e−24 | 79 |
| 2219 | 2813 | 700895231H1 | SOYMON024 | g2258074 | BLASTX | 207 | 1e−22 | 80 |
| 2220 | 2813 | 701101791H1 | SOYMON028 | g2668746 | BLASTX | 147 | 1e−13 | 77 |
| 2221 | 8040 | 701121224H1 | SOYMON037 | g534915 | BLASTN | 298 | 1e−14 | 77 |
| 2222 | 8040 | 700743066H1 | SOYMON012 | g2668746 | BLASTX | 140 | 1e−12 | 80 |
| 2223 | 8531 | 701005139H1 | SOYMON019 | g2258073 | BLASTN | 871 | 1e−63 | 79 |
| 2224 | 8531 | 701008308H1 | SOYMON019 | g534915 | BLASTN | 789 | 1e−57 | 76 |
| 2225 | 8531 | 700559054H1 | SOYMON001 | g2570500 | BLASTN | 790 | 1e−57 | 77 |
| 2226 | 8531 | 700942540H1 | SOYMON024 | g2706449 | BLASTN | 755 | 1e−54 | 80 |
| 2227 | 8531 | 700790983H1 | SOYMON011 | g2258073 | BLASTN | 431 | 1e−52 | 77 |
| 2228 | 8531 | 701007949H1 | SOYMON019 | g2570500 | BLASTN | 404 | 1e−41 | 70 |
| 2229 | 8531 | 701123827H1 | SOYMON037 | g534915 | BLASTN | 436 | 1e−26 | 75 |
| 2230 | 8531 | 701013616H1 | SOYMON019 | g534915 | BLASTN | 431 | 1e−25 | 78 |
| 2231 | 8531 | 700565624H1 | SOYMON002 | g2570501 | BLASTX | 169 | 1e−16 | 85 |
| 2232 | 8531 | 701121092H1 | SOYMON037 | g2570501 | BLASTX | 110 | 1e−15 | 60 |
| 2233 | 16 | LIB3040-003-Q1-E1-F6 | LIB3040 | g633598 | BLASTN | 523 | 1e−51 | 74 |
| 2234 | 16 | LIB3051-114-Q1-K1-G5 | LIB3051 | g790478 | BLASTN | 457 | 1e−48 | 79 |
| 2235 | 16 | LIB3039-020-Q1-E1-A2 | LIB3039 | g790478 | BLASTN | 338 | 1e−30 | 74 |
| 2236 | 2813 | LIB3028-026-Q1-B1-B7 | LIB3028 | g2570500 | BLASTN | 1029 | 1e−77 | 80 |
| 2237 | 8040 | LIB3049-045-Q1-E1-C3 | LIB3049 | g2706449 | BLASTN | 752 | 1e−52 | 72 |
| 2238 | 8040 | LIB3049-005-Q1-E1-A7 | LIB3049 | g2570501 | BLASTX | 154 | 1e−32 | 61 |
| 2239 | 8531 | LIB3050-013-Q1-E1-G8 | LIB3050 | g2570500 | BLASTN | 748 | 1e−53 | 72 |
| 2240 | 8531 | LIB3073-025-Q1-K1-D6 | LIB3073 | g534915 | BLASTN | 711 | 1e−49 | 78 |
| 2241 | 8531 | LIB3050-012-Q1-E1-D1 | LIB3050 | g2258074 | BLASTX | 93 | 1e−31 | 74 |
| SOYBEAN PYROPHOSPHATE-DEPENDENT FRUCTOSE-6-PHOSPHATE PHOSPHOTRANSFERASE | | | | | | | | |
| 2242 | 7899 | 701008645H1 | SOYMON019 | g169538 | BLASTX | 160 | 1e−15 | 83 |
| INVERTASES | | | | | | | | |
| 2243 | −700653543 | 700653543H1 | SOYMON003 | g1160487 | BLASTN | 541 | 1e−55 | 84 |
| 2244 | −700992760 | 700992760H1 | SOYMON011 | g550319 | BLASTX | 117 | 1e−12 | 49 |
| 2245 | −701005703 | 701005703H1 | SOYMON019 | g861157 | BLASTX | 213 | 1e−22 | 46 |

TABLE A*-continued

| Seq No. | Cluster ID | CloneID | Library | NCBI gi | Method | Score | P-value | % Ident |
|---|---|---|---|---|---|---|---|---|
| 2246 | −701047324 | 701047324H1 | SOYMON032 | g1160487 | BLASTN | 647 | 1e−45 | 81 |
| 2247 | −701130328 | 701130328H1 | SOYMON037 | g167551 | BLASTX | 215 | 1e−22 | 61 |
| 2248 | 20460 | 700658149H1 | SOYMON004 | g861157 | BLASTN | 198 | 1e−20 | 72 |
| 2249 | 20460 | 701041452H1 | SOYMON029 | g402740 | BLASTX | 105 | 1e−13 | 76 |
| 2250 | −GM31611 | LIB3051-002-Q1-E1-B9 | LIB3051 | g1160487 | BLASTN | 1033 | 1e−77 | 77 |
| 2251 | −GM34282 | LIB3051-025-Q1-K1-C4 | LIB3051 | g1160487 | BLASTN | 1069 | 1e−80 | 79 |
| 2252 | −GM34976 | LIB3051-031-Q1-K1-A9 | LIB3051 | g1160487 | BLASTN | 769 | 1e−66 | 80 |
| 2253 | 31949 | LIB3051-093-Q1-K1-B1 | LIB3051 | g1160487 | BLASTN | 948 | 1e−92 | 77 |
| 2254 | 31949 | LIB3051-054-Q1-K2-D11 | LIB3051 | g1160487 | BLASTN | 903 | 1e−90 | 82 |
| SOYBEAN SUCROSE SYNTHASE | | | | | | | | |
| 2255 | −700565776 | 700565776H1 | SOYMON002 | g3169544 | BLASTX | 89 | 1e−8 | 64 |
| 2256 | −700606005 | 700606005H2 | SOYMON007 | g2570066 | BLASTN | 1069 | 1e−80 | 89 |
| 2257 | −700664186 | 700664186H1 | SOYMON005 | g2606080 | BLASTN | 426 | 1e−62 | 91 |
| 2258 | −700668119 | 700668119H1 | SOYMON006 | g2570066 | BLASTN | 279 | 1e−14 | 83 |
| 2259 | −700668348 | 700668348H1 | SOYMON006 | g2570066 | BLASTN | 693 | 1e−48 | 88 |
| 2260 | −700671225 | 700671225H1 | SOYMON006 | g16525 | BLASTN | 617 | 1e−42 | 72 |
| 2261 | −700673918 | 700673918H1 | SOYMON007 | g218332 | BLASTN | 152 | 1e−9 | 92 |
| 2262 | −700726266 | 700726266H1 | SOYMON009 | g2606080 | BLASTN | 237 | 1e−21 | 79 |
| 2263 | −700747171 | 700747171H1 | SOYMON013 | g2606080 | BLASTN | 735 | 1e−52 | 89 |
| 2264 | −700747359 | 700747359H1 | SOYMON013 | g218332 | BLASTN | 447 | 1e−28 | 78 |
| 2265 | −700787443 | 700787443H2 | SOYMON011 | g22485 | BLASTN | 1171 | 1e−95 | 98 |
| 2266 | −700796035 | 700796035H1 | SOYMON017 | g2570066 | BLASTN | 1039 | 1e−77 | 90 |
| 2267 | −700832792 | 700832792H1 | SOYMON019 | g2606080 | BLASTN | 444 | 1e−31 | 88 |
| 2268 | −700836673 | 700836673H1 | SOYMON020 | g2570066 | BLASTN | 843 | 1e−61 | 85 |
| 2269 | −700841855 | 700841855H1 | SOYMON020 | g2570066 | BLASTN | 425 | 1e−35 | 84 |
| 2270 | −700851758 | 700851758H1 | SOYMON023 | g2570066 | BLASTN | 211 | 1e−15 | 91 |
| 2271 | −700851991 | 700851991H1 | SOYMON023 | g2570066 | BLASTN | 768 | 1e−55 | 81 |
| 2272 | −700852943 | 700852943H1 | SOYMON023 | g2606080 | BLASTN | 250 | 1e−13 | 85 |
| 2273 | −700853396 | 700853396H1 | SOYMON023 | g2570067 | BLASTX | 145 | 1e−13 | 65 |
| 2274 | −700872206 | 700872206H1 | SOYMON018 | g1488570 | BLASTX | 235 | 1e−25 | 64 |
| 2275 | −700876641 | 700876641H1 | SOYMON018 | g2606080 | BLASTN | 410 | 1e−53 | 88 |
| 2276 | −700890526 | 700890526H1 | SOYMON024 | g2606080 | BLASTN | 652 | 1e−60 | 83 |
| 2277 | −700893784 | 700893784H1 | SOYMON024 | g3169543 | BLASTN | 217 | 1e−11 | 82 |
| 2278 | −700909222 | 700909222H1 | SOYMON022 | g2570066 | BLASTN | 440 | 1e−44 | 72 |
| 2279 | −700944438 | 700944438H1 | SOYMON024 | g3169543 | BLASTN | 669 | 1e−46 | 73 |
| 2280 | −700945733 | 700945733H1 | SOYMON024 | g1488569 | BLASTN | 504 | 1e−33 | 66 |
| 2281 | −700969926 | 700969926H1 | SOYMON005 | g2570066 | BLASTN | 674 | 1e−47 | 72 |
| 2282 | −701001986 | 701001986H1 | SOYMON018 | g1146237 | BLASTX | 106 | 1e−9 | 45 |
| 2283 | −701005687 | 701005687H1 | SOYMON019 | g2606080 | BLASTN | 591 | 1e−40 | 85 |
| 2284 | −701012195 | 701012195H1 | SOYMON019 | g2606080 | BLASTN | 418 | 1e−46 | 77 |
| 2285 | −701046403 | 701046403H1 | SOYMON032 | g2606080 | BLASTN | 574 | 1e−38 | 76 |
| 2286 | −701058966 | 701058966H1 | SOYMON033 | g218332 | BLASTN | 529 | 1e−56 | 84 |
| 2287 | −701150574 | 701150574H1 | SOYMON031 | g1041247 | BLASTX | 155 | 1e−14 | 74 |
| 2288 | −701205210 | 701205210H1 | SOYMON035 | g218332 | BLASTN | 981 | 1e−72 | 85 |
| 2289 | 10445 | 700605276H2 | SOYMON003 | g2606080 | BLASTN | 860 | 1e−65 | 84 |
| 2290 | 10445 | 700832417H1 | SOYMON019 | g2606080 | BLASTN | 876 | 1e−64 | 82 |
| 2291 | 10445 | 700833214H1 | SOYMON019 | g2606080 | BLASTN | 740 | 1e−58 | 83 |
| 2292 | 10445 | 700832409H1 | SOYMON019 | g2606080 | BLASTN | 800 | 1e−57 | 84 |
| 2293 | 10445 | 701007169H1 | SOYMON019 | g2606080 | BLASTN | 691 | 1e−55 | 81 |
| 2294 | 10445 | 701005913H1 | SOYMON019 | g2606080 | BLASTN | 680 | 1e−52 | 83 |
| 2295 | 10445 | 701204549H2 | SOYMON035 | g2606080 | BLASTN | 732 | 1e−52 | 83 |
| 2296 | 10445 | 701208347H1 | SOYMON035 | g2606080 | BLASTN | 656 | 1e−49 | 83 |
| 2297 | 10445 | 700958980H1 | SOYMON022 | g2606080 | BLASTN | 670 | 1e−49 | 83 |
| 2298 | 10445 | 700988126H1 | SOYMON009 | g2606080 | BLASTN | 324 | 1e−47 | 78 |
| 2299 | 10445 | 700830464H1 | SOYMON019 | g2606080 | BLASTN | 347 | 1e−47 | 79 |
| 2300 | 10445 | 700763911H1 | SOYMON019 | g3169543 | BLASTN | 517 | 1e−47 | 75 |
| 2301 | 10445 | 700891996H1 | SOYMON024 | g2606080 | BLASTN | 667 | 1e−46 | 88 |
| 2302 | 10445 | 700725104H1 | SOYMON009 | g2606080 | BLASTN | 577 | 1e−45 | 81 |
| 2303 | 10445 | 701124001H1 | SOYMON037 | g2606080 | BLASTN | 648 | 1e−45 | 86 |
| 2304 | 10445 | 700833919H1 | SOYMON019 | g2606080 | BLASTN | 496 | 1e−41 | 79 |
| 2305 | 10445 | 701006692H1 | SOYMON019 | g2606080 | BLASTN | 536 | 1e−41 | 86 |
| 2306 | 10445 | 700905349H1 | SOYMON022 | g2606080 | BLASTN | 585 | 1e−39 | 75 |
| 2307 | 10445 | 701204596H2 | SOYMON035 | g2606080 | BLASTN | 521 | 1e−38 | 79 |
| 2308 | 10445 | 700958885H1 | SOYMON022 | g2606080 | BLASTN | 351 | 1e−36 | 81 |
| 2309 | 10445 | 701208390H1 | SOYMON035 | g2606080 | BLASTN | 259 | 1e−29 | 86 |
| 2310 | 10445 | 701003131H1 | SOYMON019 | g2606080 | BLASTN | 442 | 1e−26 | 76 |

TABLE A*-continued

| Seq No. | Cluster ID | CloneID | Library | NCBI gi | Method | Score | P-value | % Ident |
|---|---|---|---|---|---|---|---|---|
| 2311 | 10445 | 701207712H1 | SOYMON035 | g2606080 | BLASTN | 260 | 1e-17 | 78 |
| 2312 | 10445 | 701215107H1 | SOYMON035 | g2606080 | BLASTN | 260 | 1e-14 | 88 |
| 2313 | 10445 | 700852649H1 | SOYMON023 | g2606080 | BLASTN | 254 | 1e-13 | 74 |
| 2314 | 11259 | 701063407H1 | SOYMON033 | g2570066 | BLASTN | 1100 | 1e-82 | 87 |
| 2315 | 11259 | 700674761H1 | SOYMON007 | g2570066 | BLASTN | 739 | 1e-71 | 86 |
| 2316 | 11259 | 700839148H1 | SOYMON020 | g2570066 | BLASTN | 919 | 1e-67 | 87 |
| 2317 | 11259 | 700674815H1 | SOYMON007 | g2570066 | BLASTN | 904 | 1e-66 | 87 |
| 2318 | 12890 | 701103318H1 | SOYMON028 | g2570066 | BLASTN | 1005 | 1e-74 | 86 |
| 2319 | 12890 | 700855911H1 | SOYMON023 | g2570066 | BLASTN | 569 | 1e-69 | 86 |
| 2320 | 12890 | 700850874H1 | SOYMON023 | g2570066 | BLASTN | 937 | 1e-69 | 90 |
| 2321 | 12890 | 700837552H1 | SOYMON020 | g2570066 | BLASTN | 888 | 1e-65 | 89 |
| 2322 | 14264 | 700677058H1 | SOYMON007 | g2606080 | BLASTN | 578 | 1e-39 | 99 |
| 2323 | 14264 | 700679301H1 | SOYMON007 | g2606080 | BLASTN | 325 | 1e-18 | 90 |
| 2324 | 14740 | 701214452H1 | SOYMON035 | g2570066 | BLASTN | 1072 | 1e-80 | 89 |
| 2325 | 14740 | 701044972H1 | SOYMON032 | g2570066 | BLASTN | 537 | 1e-43 | 87 |
| 2326 | 14740 | 701040560H1 | SOYMON029 | g2570066 | BLASTN | 302 | 1e-24 | 75 |
| 2327 | 14740 | 700793901H1 | SOYMON017 | g2570066 | BLASTN | 231 | 1e-14 | 84 |
| 2328 | 15394 | 701136903H1 | SOYMON038 | g2606080 | BLASTN | 936 | 1e-69 | 81 |
| 2329 | 15394 | 701004431H1 | SOYMON019 | g218332 | BLASTN | 942 | 1e-69 | 80 |
| 2330 | 15394 | 701006153H1 | SOYMON019 | g218332 | BLASTN | 920 | 1e-67 | 83 |
| 2331 | 15394 | 701138281H1 | SOYMON038 | g218332 | BLASTN | 485 | 1e-40 | 82 |
| 2332 | 15394 | 701209319H1 | SOYMON035 | g3169543 | BLASTN | 508 | 1e-33 | 81 |
| 2333 | 16344 | 700746372H1 | SOYMON013 | g2606080 | BLASTN | 471 | 1e-65 | 85 |
| 2334 | 16344 | 700945706H1 | SOYMON024 | g2606080 | BLASTN | 635 | 1e-65 | 84 |
| 2335 | 17781 | 700960671H1 | SOYMON022 | g2570066 | BLASTN | 966 | 1e-71 | 88 |
| 2336 | 17781 | 700838540H1 | SOYMON020 | g2570066 | BLASTN | 532 | 1e-62 | 83 |
| 2337 | 20151 | 700847184H1 | SOYMON021 | g2570066 | BLASTN | 762 | 1e-72 | 90 |
| 2338 | 20151 | 700831558H1 | SOYMON019 | g2570066 | BLASTN | 980 | 1e-72 | 89 |
| 2339 | 22196 | 701046171H1 | SOYMON032 | g2606080 | BLASTN | 1321 | 1e-101 | 99 |
| 2340 | 22196 | 701207390H1 | SOYMON035 | g2606080 | BLASTN | 1258 | 1e-95 | 98 |
| 2341 | 25275 | 701013025H1 | SOYMON019 | g2606080 | BLASTN | 1353 | 1e-103 | 98 |
| 2342 | 25275 | 700561738H1 | SOYMON002 | g2606080 | BLASTN | 953 | 1e-84 | 91 |
| 2343 | 25380 | 700667735H1 | SOYMON006 | g2570066 | BLASTN | 959 | 1e-71 | 87 |
| 2344 | 25380 | 701047629H1 | SOYMON032 | g2570066 | BLASTN | 774 | 1e-55 | 89 |
| 2345 | 26818 | 701047072H1 | SOYMON032 | g2606080 | BLASTN | 830 | 1e-60 | 87 |
| 2346 | 26818 | 700737511H1 | SOYMON010 | g3169543 | BLASTN | 607 | 1e-57 | 83 |
| 2347 | 31182 | 701098655H1 | SOYMON028 | g2570066 | BLASTN | 951 | 1e-70 | 85 |
| 2348 | 318 | 701052316H1 | SOYMON032 | g2606080 | BLASTN | 1555 | 1e-120 | 100 |
| 2349 | 318 | 701053115H1 | SOYMON032 | g2606080 | BLASTN | 1281 | 1e-111 | 96 |
| 2350 | 318 | 700983049H1 | SOYMON009 | g2606080 | BLASTN | 1438 | 1e-110 | 96 |
| 2351 | 318 | 701058416H1 | SOYMON033 | g2606080 | BLASTN | 1385 | 1e-106 | 100 |
| 2352 | 318 | 701013289H1 | SOYMON019 | g2606080 | BLASTN | 1374 | 1e-105 | 99 |
| 2353 | 318 | 701002784H2 | SOYMON019 | g2606080 | BLASTN | 1365 | 1e-104 | 100 |
| 2354 | 318 | 700868516H1 | SOYMON016 | g2606080 | BLASTN | 1195 | 1e-103 | 100 |
| 2355 | 318 | 700978851H1 | SOYMON009 | g2606080 | BLASTN | 1325 | 1e-101 | 98 |
| 2356 | 318 | 701204954H1 | SOYMON035 | g2606080 | BLASTN | 770 | 1e-100 | 100 |
| 2357 | 318 | 700889102H1 | SOYMON024 | g2606080 | BLASTN | 1048 | 1e-100 | 99 |
| 2358 | 318 | 701053120H1 | SOYMON032 | g218332 | BLASTN | 1109 | 1e-100 | 90 |
| 2359 | 318 | 700731734H1 | SOYMON010 | g2606080 | BLASTN | 1308 | 1e-100 | 97 |
| 2360 | 318 | 700972625H1 | SOYMON005 | g2606080 | BLASTN | 1120 | 1e-98 | 99 |
| 2361 | 318 | 701006566H1 | SOYMON019 | g2606080 | BLASTN | 983 | 1e-97 | 99 |
| 2362 | 318 | 700952789H1 | SOYMON022 | g2606080 | BLASTN | 1276 | 1e-97 | 97 |
| 2363 | 318 | 701141518H1 | SOYMON038 | g2606080 | BLASTN | 716 | 1e-96 | 99 |
| 2364 | 318 | 700653475H1 | SOYMON003 | g3169543 | BLASTN | 1262 | 1e-96 | 87 |
| 2365 | 318 | 700650832H1 | SOYMON003 | g2606080 | BLASTN | 643 | 1e-95 | 97 |
| 2366 | 318 | 700678981H1 | SOYMON007 | g2606080 | BLASTN | 1142 | 1e-95 | 96 |
| 2367 | 318 | 700890311H1 | SOYMON024 | g2606080 | BLASTN | 1200 | 1e-95 | 100 |
| 2368 | 318 | 700892212H1 | SOYMON024 | g2606080 | BLASTN | 1250 | 1e-95 | 97 |
| 2369 | 318 | 700943424H1 | SOYMON024 | g2606080 | BLASTN | 1251 | 1e-95 | 99 |
| 2370 | 318 | 700833982H1 | SOYMON019 | g2606080 | BLASTN | 1255 | 1e-95 | 100 |
| 2371 | 318 | 700834361H1 | SOYMON019 | g2606080 | BLASTN | 981 | 1e-94 | 99 |
| 2372 | 318 | 700746379H1 | SOYMON013 | g2606080 | BLASTN | 1108 | 1e-94 | 96 |
| 2373 | 318 | 700889648H1 | SOYMON024 | g2606080 | BLASTN | 1238 | 1e-94 | 99 |
| 2374 | 318 | 701054868H1 | SOYMON032 | g2606080 | BLASTN | 1243 | 1e-94 | 95 |
| 2375 | 318 | 700959914H1 | SOYMON022 | g2606080 | BLASTN | 1226 | 1e-93 | 96 |
| 2376 | 318 | 701011518H1 | SOYMON019 | g2606080 | BLASTN | 705 | 1e-92 | 99 |
| 2377 | 318 | 700734053H1 | SOYMON010 | g2606080 | BLASTN | 765 | 1e-92 | 100 |
| 2378 | 318 | 701005295H1 | SOYMON019 | g2606080 | BLASTN | 962 | 1e-92 | 93 |
| 2379 | 318 | 700945690H1 | SOYMON024 | g2606080 | BLASTN | 1054 | 1e-92 | 99 |
| 2380 | 318 | 701118196H1 | SOYMON037 | g2606080 | BLASTN | 1100 | 1e-92 | 95 |
| 2381 | 318 | 700673512H1 | SOYMON007 | g2606080 | BLASTN | 1211 | 1e-92 | 97 |
| 2382 | 318 | 700852712H1 | SOYMON023 | g2606080 | BLASTN | 1215 | 1e-92 | 98 |
| 2383 | 318 | 701004755H1 | SOYMON019 | g2606080 | BLASTN | 1221 | 1e-92 | 99 |
| 2384 | 318 | 700677915H1 | SOYMON007 | g2606080 | BLASTN | 685 | 1e-91 | 99 |
| 2385 | 318 | 700977846H1 | SOYMON009 | g2606080 | BLASTN | 731 | 1e-91 | 99 |

TABLE A*-continued

| Seq No. | Cluster ID | CloneID | Library | NCBI gi | Method | Score | P-value | % Ident |
|---|---|---|---|---|---|---|---|---|
| 2386 | 318 | 700831789H1 | SOYMON019 | g2606080 | BLASTN | 1204 | 1e-91 | 97 |
| 2387 | 318 | 700754901H1 | SOYMON014 | g2606080 | BLASTN | 1205 | 1e-91 | 100 |
| 2388 | 318 | 700666594H1 | SOYMON005 | g2606080 | BLASTN | 1210 | 1e-91 | 100 |
| 2389 | 318 | 700750890H1 | SOYMON014 | g2606080 | BLASTN | 1188 | 1e-90 | 99 |
| 2390 | 318 | 700890229H1 | SOYMON024 | g2606080 | BLASTN | 1195 | 1e-90 | 100 |
| 2391 | 318 | 700732660H1 | SOYMON010 | g2606080 | BLASTN | 1154 | 1e-89 | 95 |
| 2392 | 318 | 700764730H1 | SOYMON023 | g2606080 | BLASTN | 1181 | 1e-89 | 99 |
| 2393 | 318 | 701050015H1 | SOYMON032 | g218332 | BLASTN | 1185 | 1e-89 | 89 |
| 2394 | 318 | 700870180H1 | SOYMON016 | g2606080 | BLASTN | 710 | 1e-88 | 100 |
| 2395 | 318 | 701204236H2 | SOYMON035 | g2606080 | BLASTN | 904 | 1e-88 | 98 |
| 2396 | 318 | 700645782H1 | SOYMON010 | g2606080 | BLASTN | 633 | 1e-87 | 95 |
| 2397 | 318 | 700831711H1 | SOYMON019 | g2606080 | BLASTN | 1025 | 1e-87 | 96 |
| 2398 | 318 | 701056026H1 | SOYMON032 | g2606080 | BLASTN | 1158 | 1e-87 | 96 |
| 2399 | 318 | 700678853H1 | SOYMON007 | g2606080 | BLASTN | 1161 | 1e-87 | 97 |
| 2400 | 318 | 700852424H1 | SOYMON023 | g2606080 | BLASTN | 913 | 1e-86 | 95 |
| 2401 | 318 | 701049116H1 | SOYMON032 | g3169543 | BLASTN | 1146 | 1e-86 | 89 |
| 2402 | 318 | 700977788H1 | SOYMON009 | g2606080 | BLASTN | 642 | 1e-85 | 94 |
| 2403 | 318 | 700833546H1 | SOYMON019 | g2606080 | BLASTN | 1134 | 1e-85 | 94 |
| 2404 | 318 | 701004915H1 | SOYMON019 | g2606080 | BLASTN | 591 | 1e-84 | 96 |
| 2405 | 318 | 700730093H1 | SOYMON009 | g2606080 | BLASTN | 755 | 1e-84 | 96 |
| 2406 | 318 | 701119060H1 | SOYMON037 | g2606080 | BLASTN | 824 | 1e-84 | 97 |
| 2407 | 318 | 700963024H1 | SOYMON022 | g2606080 | BLASTN | 1116 | 1e-84 | 90 |
| 2408 | 318 | 700563532H1 | SOYMON002 | g22037 | BLASTN | 1116 | 1e-84 | 87 |
| 2409 | 318 | 700755891H1 | SOYMON014 | g2606080 | BLASTN | 1117 | 1e-84 | 94 |
| 2410 | 318 | 700850605H1 | SOYMON023 | g2606080 | BLASTN | 1118 | 1e-84 | 94 |
| 2411 | 318 | 700888245H1 | SOYMON024 | g2606080 | BLASTN | 643 | 1e-83 | 98 |
| 2412 | 318 | 701037091H1 | SOYMON029 | g2606080 | BLASTN | 821 | 1e-83 | 95 |
| 2413 | 318 | 700673790H1 | SOYMON007 | g2606080 | BLASTN | 1104 | 1e-83 | 95 |
| 2414 | 318 | 700845518H1 | SOYMON021 | g2606080 | BLASTN | 673 | 1e-82 | 91 |
| 2415 | 318 | 700854591H1 | SOYMON023 | g2606080 | BLASTN | 606 | 1e-81 | 95 |
| 2416 | 318 | 700907167H1 | SOYMON022 | g2606080 | BLASTN | 920 | 1e-81 | 96 |
| 2417 | 318 | 700978575H1 | SOYMON009 | g218332 | BLASTN | 971 | 1e-81 | 91 |
| 2418 | 318 | 700853484H1 | SOYMON023 | g2606080 | BLASTN | 1079 | 1e-81 | 92 |
| 2419 | 318 | 701124012H1 | SOYMON037 | g218332 | BLASTN | 1083 | 1e-81 | 89 |
| 2420 | 318 | 700835387H1 | SOYMON019 | g2606080 | BLASTN | 1087 | 1e-81 | 96 |
| 2421 | 318 | 700749133H1 | SOYMON013 | g2606080 | BLASTN | 571 | 1e-80 | 98 |
| 2422 | 318 | 700727185H1 | SOYMON009 | g2606080 | BLASTN | 730 | 1e-80 | 98 |
| 2423 | 318 | 700869024H1 | SOYMON016 | g2606080 | BLASTN | 807 | 1e-79 | 96 |
| 2424 | 318 | 701013537H1 | SOYMON019 | g2606080 | BLASTN | 929 | 1e-79 | 87 |
| 2425 | 318 | 701010402H1 | SOYMON019 | g218332 | BLASTN | 1055 | 1e-79 | 85 |
| 2426 | 318 | 701107955H1 | SOYMON036 | g2606080 | BLASTN | 1058 | 1e-79 | 87 |
| 2427 | 318 | 700731653H1 | SOYMON010 | g2606080 | BLASTN | 578 | 1e-78 | 94 |
| 2428 | 318 | 700888950H1 | SOYMON024 | g218332 | BLASTN | 765 | 1e-78 | 88 |
| 2429 | 318 | 700894112H1 | SOYMON024 | g2606080 | BLASTN | 842 | 1e-78 | 98 |
| 2430 | 318 | 701005565H1 | SOYMON019 | g2606080 | BLASTN | 1024 | 1e-78 | 92 |
| 2431 | 318 | 700548286H1 | SOYMON002 | g2606080 | BLASTN | 1045 | 1e-78 | 88 |
| 2432 | 318 | 700975854H1 | SOYMON009 | g22037 | BLASTN | 1053 | 1e-78 | 86 |
| 2433 | 318 | 700944525H1 | SOYMON024 | g218332 | BLASTN | 1054 | 1e-78 | 89 |
| 2434 | 318 | 701061312H1 | SOYMON033 | g2606080 | BLASTN | 773 | 1e-77 | 87 |
| 2435 | 318 | 700831277H1 | SOYMON019 | g2606080 | BLASTN | 947 | 1e-77 | 97 |
| 2436 | 318 | 700788482H1 | SOYMON011 | g2606080 | BLASTN | 1038 | 1e-77 | 89 |
| 2437 | 318 | 701055686H1 | SOYMON032 | g2606080 | BLASTN | 1039 | 1e-77 | 90 |
| 2438 | 318 | 701054768H1 | SOYMON032 | g2606080 | BLASTN | 786 | 1e-76 | 88 |
| 2439 | 318 | 700854891H1 | SOYMON023 | g2606080 | BLASTN | 1030 | 1e-76 | 93 |
| 2440 | 318 | 701215276H1 | SOYMON035 | g2606080 | BLASTN | 1030 | 1e-76 | 90 |
| 2441 | 318 | 700944860H1 | SOYMON024 | g2606080 | BLASTN | 887 | 1e-75 | 96 |
| 2442 | 318 | 701010957H1 | SOYMON019 | g2606080 | BLASTN | 1011 | 1e-75 | 87 |
| 2443 | 318 | 701007175H1 | SOYMON019 | g2606080 | BLASTN | 1013 | 1e-75 | 90 |
| 2444 | 318 | 700725567H1 | SOYMON009 | g2606080 | BLASTN | 1013 | 1e-75 | 93 |
| 2445 | 318 | 700904972H1 | SOYMON022 | g22037 | BLASTN | 1015 | 1e-75 | 89 |
| 2446 | 318 | 700747391H1 | SOYMON013 | g2606080 | BLASTN | 1017 | 1e-75 | 87 |
| 2447 | 318 | 700747523H1 | SOYMON013 | g22037 | BLASTN | 836 | 1e-74 | 86 |
| 2448 | 318 | 700561819H1 | SOYMON002 | g218332 | BLASTN | 999 | 1e-74 | 82 |
| 2449 | 318 | 700835961H1 | SOYMON019 | g218332 | BLASTN | 1006 | 1e-74 | 87 |
| 2450 | 318 | 700562318H1 | SOYMON002 | g2606080 | BLASTN | 986 | 1e-73 | 84 |
| 2451 | 318 | 700745092H1 | SOYMON013 | g2606080 | BLASTN | 987 | 1e-73 | 88 |
| 2452 | 318 | 700832618H1 | SOYMON019 | g2606080 | BLASTN | 975 | 1e-72 | 87 |
| 2453 | 318 | 700891092H1 | SOYMON024 | g2606080 | BLASTN | 982 | 1e-72 | 88 |
| 2454 | 318 | 701119264H1 | SOYMON037 | g2606080 | BLASTN | 690 | 1e-71 | 89 |
| 2455 | 318 | 700894436H1 | SOYMON024 | g2606080 | BLASTN | 901 | 1e-71 | 91 |
| 2456 | 318 | 700894532H1 | SOYMON024 | g22037 | BLASTN | 959 | 1e-71 | 89 |
| 2457 | 318 | 700891712H1 | SOYMON024 | g22037 | BLASTN | 960 | 1e-71 | 89 |
| 2458 | 318 | 700895985H1 | SOYMON027 | g2606080 | BLASTN | 964 | 1e-71 | 89 |
| 2459 | 318 | 701203243H1 | SOYMON035 | g2606080 | BLASTN | 969 | 1e-71 | 88 |
| 2460 | 318 | 700985945H1 | SOYMON009 | g218332 | BLASTN | 713 | 1e-70 | 90 |

TABLE A*-continued

| Seq No. | Cluster ID | CloneID | Library | NCBI gi | Method | Score | P-value | % Ident |
|---|---|---|---|---|---|---|---|---|
| 2461 | 318 | 700984768H1 | SOYMON009 | g2606080 | BLASTN | 781 | 1e-69 | 84 |
| 2462 | 318 | 700675710H1 | SOYMON007 | g2606080 | BLASTN | 784 | 1e-69 | 91 |
| 2463 | 318 | 700829561H1 | SOYMON019 | g218332 | BLASTN | 935 | 1e-69 | 87 |
| 2464 | 318 | 700964918H1 | SOYMON022 | g22037 | BLASTN | 942 | 1e-69 | 83 |
| 2465 | 318 | 701046747H1 | SOYMON032 | g2606080 | BLASTN | 422 | 1e-68 | 84 |
| 2466 | 318 | 700745512H1 | SOYMON013 | g3169543 | BLASTN | 457 | 1e-68 | 85 |
| 2467 | 318 | 700666671H1 | SOYMON005 | g218332 | BLASTN | 506 | 1e-68 | 87 |
| 2468 | 318 | 700889555H1 | SOYMON024 | g3169543 | BLASTN | 930 | 1e-68 | 86 |
| 2469 | 318 | 701147844H1 | SOYMON031 | g3169543 | BLASTN | 932 | 1e-68 | 86 |
| 2470 | 318 | 701206247H1 | SOYMON035 | g3169543 | BLASTN | 934 | 1e-68 | 82 |
| 2471 | 318 | 701103801H1 | SOYMON036 | g218332 | BLASTN | 723 | 1e-67 | 88 |
| 2472 | 318 | 700943746H1 | SOYMON024 | g218332 | BLASTN | 913 | 1e-67 | 86 |
| 2473 | 318 | 700745956H1 | SOYMON013 | g22037 | BLASTN | 921 | 1e-67 | 83 |
| 2474 | 318 | 700893512H1 | SOYMON024 | g218332 | BLASTN | 835 | 1e-66 | 90 |
| 2475 | 318 | 700897675H1 | SOYMON027 | g22037 | BLASTN | 899 | 1e-66 | 83 |
| 2476 | 318 | 700565777H1 | SOYMON002 | g2606080 | BLASTN | 510 | 1e-65 | 89 |
| 2477 | 318 | 700749851H1 | SOYMON013 | g2606080 | BLASTN | 887 | 1e-65 | 89 |
| 2478 | 318 | 700746286H1 | SOYMON013 | g2606080 | BLASTN | 876 | 1e-64 | 82 |
| 2479 | 318 | 700869142H1 | SOYMON016 | g2606080 | BLASTN | 885 | 1e-64 | 100 |
| 2480 | 318 | 700892442H1 | SOYMON024 | g2606080 | BLASTN | 872 | 1e-63 | 84 |
| 2481 | 318 | 700964153H1 | SOYMON022 | g22037 | BLASTN | 873 | 1e-63 | 83 |
| 2482 | 318 | 700898176H1 | SOYMON027 | g3169543 | BLASTN | 873 | 1e-63 | 84 |
| 2483 | 318 | 701056245H1 | SOYMON032 | g218332 | BLASTN | 543 | 1e-61 | 84 |
| 2484 | 318 | 700835360H1 | SOYMON019 | g218332 | BLASTN | 839 | 1e-61 | 88 |
| 2485 | 318 | 700749067H1 | SOYMON013 | g3169543 | BLASTN | 473 | 1e-60 | 86 |
| 2486 | 318 | 701008962H1 | SOYMON019 | g3169543 | BLASTN | 614 | 1e-60 | 90 |
| 2487 | 318 | 700980315H1 | SOYMON009 | g3169543 | BLASTN | 655 | 1e-60 | 84 |
| 2488 | 318 | 701202680H1 | SOYMON035 | g2606080 | BLASTN | 678 | 1e-60 | 89 |
| 2489 | 318 | 701202364H1 | SOYMON035 | g2606080 | BLASTN | 711 | 1e-60 | 85 |
| 2490 | 318 | 701037195H1 | SOYMON029 | g218332 | BLASTN | 439 | 1e-59 | 86 |
| 2491 | 318 | 701011681H1 | SOYMON024 | g3169543 | BLASTN | 459 | 1e-59 | 83 |
| 2492 | 318 | 700976368H1 | SOYMON009 | g218332 | BLASTN | 363 | 1e-58 | 85 |
| 2493 | 318 | 700829847H1 | SOYMON019 | g218332 | BLASTN | 384 | 1e-58 | 86 |
| 2494 | 318 | 700561920H1 | SOYMON002 | g2606080 | BLASTN | 809 | 1e-58 | 88 |
| 2495 | 318 | 701004573H1 | SOYMON019 | g2606080 | BLASTN | 813 | 1e-58 | 77 |
| 2496 | 318 | 701049462H1 | SOYMON032 | g3169543 | BLASTN | 450 | 1e-57 | 82 |
| 2497 | 318 | 700866272H1 | SOYMON016 | g3169543 | BLASTN | 421 | 1e-54 | 77 |
| 2498 | 318 | 700892632H1 | SOYMON024 | g2606080 | BLASTN | 453 | 1e-54 | 84 |
| 2499 | 318 | 701215184H1 | SOYMON035 | g218332 | BLASTN | 464 | 1e-54 | 88 |
| 2500 | 318 | 700831177H1 | SOYMON019 | g2606080 | BLASTN | 759 | 1e-54 | 85 |
| 2501 | 318 | 700835115H1 | SOYMON019 | g2606080 | BLASTN | 762 | 1e-54 | 81 |
| 2502 | 318 | 701015056H1 | SOYMON019 | g3169543 | BLASTN | 447 | 1e-53 | 81 |
| 2503 | 318 | 700675496H1 | SOYMON007 | g2606080 | BLASTN | 465 | 1e-53 | 95 |
| 2504 | 318 | 701052767H1 | SOYMON032 | g2606080 | BLASTN | 753 | 1e-53 | 88 |
| 2505 | 318 | 700833078H1 | SOYMON019 | g3169543 | BLASTN | 414 | 1e-52 | 84 |
| 2506 | 318 | 700869165H1 | SOYMON016 | g3169543 | BLASTN | 534 | 1e-51 | 84 |
| 2507 | 318 | 700831532H1 | SOYMON019 | g2606080 | BLASTN | 655 | 1e-51 | 100 |
| 2508 | 318 | 701010104H2 | SOYMON019 | g2606080 | BLASTN | 698 | 1e-51 | 85 |
| 2509 | 318 | 700890513H1 | SOYMON024 | g22037 | BLASTN | 575 | 1e-50 | 88 |
| 2510 | 318 | 700890952H1 | SOYMON024 | g2606080 | BLASTN | 709 | 1e-50 | 75 |
| 2511 | 318 | 700567301H1 | SOYMON002 | g22037 | BLASTN | 716 | 1e-50 | 82 |
| 2512 | 318 | 700945284H1 | SOYMON024 | g3169543 | BLASTN | 701 | 1e-49 | 75 |
| 2513 | 318 | 701206626H1 | SOYMON035 | g3169543 | BLASTN | 702 | 1e-49 | 81 |
| 2514 | 318 | 700748456H1 | SOYMON013 | g2606080 | BLASTN | 384 | 1e-48 | 77 |
| 2515 | 318 | 700981883H1 | SOYMON009 | g2606080 | BLASTN | 419 | 1e-48 | 85 |
| 2516 | 318 | 700942575H1 | SOYMON024 | g22037 | BLASTN | 340 | 1e-46 | 82 |
| 2517 | 318 | 700945125H1 | SOYMON024 | g2606080 | BLASTN | 405 | 1e-46 | 81 |
| 2518 | 318 | 700830469H1 | SOYMON019 | g3169543 | BLASTN | 636 | 1e-44 | 83 |
| 2519 | 318 | 700991669H1 | SOYMON011 | g218332 | BLASTN | 630 | 1e-43 | 83 |
| 2520 | 318 | 700866064H1 | SOYMON016 | g3169543 | BLASTN | 453 | 1e-41 | 84 |
| 2521 | 318 | 700866806H1 | SOYMON016 | g218332 | BLASTN | 607 | 1e-41 | 96 |
| 2522 | 318 | 700893154H1 | SOYMON024 | g2606080 | BLASTN | 539 | 1e-38 | 87 |
| 2523 | 318 | 700893118H1 | SOYMON024 | g2606080 | BLASTN | 539 | 1e-38 | 87 |
| 2524 | 318 | 701142963H2 | SOYMON038 | g218332 | BLASTN | 569 | 1e-38 | 90 |
| 2525 | 318 | 700945968H1 | SOYMON024 | g218332 | BLASTN | 572 | 1e-38 | 86 |
| 2526 | 318 | 700945788H1 | SOYMON024 | g2606080 | BLASTN | 514 | 1e-36 | 90 |
| 2527 | 318 | 700563455H1 | SOYMON002 | g2606080 | BLASTN | 496 | 1e-32 | 83 |
| 2528 | 318 | 700888936H1 | SOYMON024 | g3169543 | BLASTN | 498 | 1e-32 | 86 |
| 2529 | 318 | 701039594H1 | SOYMON029 | g22037 | BLASTN | 254 | 1e-28 | 84 |
| 2530 | 318 | 701015024H1 | SOYMON019 | g218333 | BLASTX | 65 | 1e-14 | 66 |
| 2531 | 318 | 700893166H1 | SOYMON024 | g22037 | BLASTX | 232 | 1e-8 | 85 |
| 2532 | 4258 | 700646449H1 | SOYMON013 | g22037 | BLASTN | 584 | 1e-39 | 70 |
| 2533 | 4258 | 700952838H1 | SOYMON022 | g20373 | BLASTN | 557 | 1e-37 | 70 |
| 2534 | 4413 | 700902256H1 | SOYMON027 | g2606080 | BLASTN | 1215 | 1e-99 | 97 |
| 2535 | 4413 | 700900032H1 | SOYMON027 | g2606080 | BLASTN | 720 | 1e-95 | 98 |

TABLE A*-continued

| Seq No. | Cluster ID | CloneID | Library | NCBI gi | Method | Score | P-value | % Ident |
|---|---|---|---|---|---|---|---|---|
| 2536 | 4413 | 701006182H1 | SOYMON019 | g2606080 | BLASTN | 1179 | 1e−89 | 99 |
| 2537 | 4413 | 700831710H1 | SOYMON019 | g2606080 | BLASTN | 1070 | 1e−80 | 97 |
| 2538 | 4413 | 701008850H1 | SOYMON019 | g2606080 | BLASTN | 999 | 1e−74 | 99 |
| 2539 | 4413 | 701015432H1 | SOYMON019 | g2606080 | BLASTN | 813 | 1e−68 | 95 |
| 2540 | 4413 | 700987094H1 | SOYMON009 | g2606080 | BLASTN | 928 | 1e−68 | 84 |
| 2541 | 4413 | 700736179H1 | SOYMON010 | g2606080 | BLASTN | 753 | 1e−63 | 96 |
| 2542 | 4413 | 700890230H1 | SOYMON024 | g2606080 | BLASTN | 798 | 1e−57 | 95 |
| 2543 | 4413 | 701015314H1 | SOYMON019 | g2606080 | BLASTN | 639 | 1e−49 | 97 |
| 2544 | 4413 | 701052019H1 | SOYMON032 | g2606080 | BLASTN | 448 | 1e−37 | 95 |
| 2545 | 4748 | 701209527H1 | SOYMON035 | g2606080 | BLASTN | 1207 | 1e−91 | 93 |
| 2546 | 4748 | 700561984H1 | SOYMON002 | g2606080 | BLASTN | 542 | 1e−81 | 94 |
| 2547 | 4748 | 700895166H1 | SOYMON024 | g2606080 | BLASTN | 1004 | 1e−74 | 98 |
| 2548 | 4748 | 700843735H1 | SOYMON021 | g2606080 | BLASTN | 227 | 1e−20 | 93 |
| 2549 | 869 | 700650545H1 | SOYMON003 | g2606080 | BLASTN | 804 | 1e−107 | 94 |
| 2550 | 869 | 701205255H1 | SOYMON035 | g2606080 | BLASTN | 1135 | 1e−101 | 98 |
| 2551 | 869 | 700562091H1 | SOYMON002 | g2606080 | BLASTN | 1311 | 1e−100 | 92 |
| 2552 | 869 | 701213906H1 | SOYMON035 | g2606080 | BLASTN | 1300 | 1e−99 | 100 |
| 2553 | 869 | 700567712H1 | SOYMON002 | g2606080 | BLASTN | 634 | 1e−95 | 97 |
| 2554 | 869 | 701010943H1 | SOYMON019 | g2606080 | BLASTN | 1236 | 1e−94 | 99 |
| 2555 | 869 | 701006976H1 | SOYMON019 | g2606080 | BLASTN | 601 | 1e−93 | 98 |
| 2556 | 869 | 700752409H1 | SOYMON014 | g2606080 | BLASTN | 1080 | 1e−92 | 100 |
| 2557 | 869 | 701204769H1 | SOYMON035 | g2606080 | BLASTN | 795 | 1e−90 | 100 |
| 2558 | 869 | 701042737H1 | SOYMON029 | g2606080 | BLASTN | 1058 | 1e−90 | 99 |
| 2559 | 869 | 700832091H1 | SOYMON019 | g2606080 | BLASTN | 1116 | 1e−88 | 99 |
| 2560 | 869 | 701049161H1 | SOYMON032 | g2606080 | BLASTN | 1053 | 1e−86 | 96 |
| 2561 | 869 | 700906541H1 | SOYMON022 | g2606080 | BLASTN | 1087 | 1e−86 | 96 |
| 2562 | 869 | 701008182H1 | SOYMON019 | g2606080 | BLASTN | 1111 | 1e−86 | 92 |
| 2563 | 869 | 700831609H1 | SOYMON019 | g2606080 | BLASTN | 611 | 1e−84 | 92 |
| 2564 | 869 | 700834954H1 | SOYMON019 | g2606080 | BLASTN | 835 | 1e−84 | 100 |
| 2565 | 869 | 701037284H1 | SOYMON029 | g2606080 | BLASTN | 858 | 1e−83 | 94 |
| 2566 | 869 | 700561458H1 | SOYMON002 | g2606080 | BLASTN | 1019 | 1e−83 | 93 |
| 2567 | 869 | 701208357H1 | SOYMON035 | g2606080 | BLASTN | 1113 | 1e−83 | 99 |
| 2568 | 869 | 700747138H1 | SOYMON013 | g2606080 | BLASTN | 985 | 1e−80 | 93 |
| 2569 | 869 | 701014835H1 | SOYMON019 | g2606080 | BLASTN | 891 | 1e−78 | 89 |
| 2570 | 869 | 700956359H1 | SOYMON022 | g2606080 | BLASTN | 1052 | 1e−78 | 96 |
| 2571 | 869 | 701012740H1 | SOYMON019 | g2606080 | BLASTN | 643 | 1e−77 | 93 |
| 2572 | 869 | 701042523H1 | SOYMON029 | g2606080 | BLASTN | 667 | 1e−74 | 95 |
| 2573 | 869 | 701205775H1 | SOYMON035 | g2606080 | BLASTN | 745 | 1e−74 | 100 |
| 2574 | 869 | 701049184H1 | SOYMON032 | g2606080 | BLASTN | 600 | 1e−72 | 95 |
| 2575 | 869 | 700889179H1 | SOYMON024 | g2606080 | BLASTN | 942 | 1e−69 | 92 |
| 2576 | 869 | 700963920H1 | SOYMON022 | g2606080 | BLASTN | 718 | 1e−66 | 90 |
| 2577 | 869 | 700737476H1 | SOYMON010 | g2606080 | BLASTN | 548 | 1e−44 | 97 |
| 2578 | 869 | 701044544H1 | SOYMON032 | g2606080 | BLASTN | 462 | 1e−43 | 96 |
| 2579 | 869 | 700737636H1 | SOYMON010 | g2606080 | BLASTN | 426 | 1e−34 | 95 |
| 2580 | 9398 | 700837013H1 | SOYMON020 | g2570066 | BLASTN | 1025 | 1e−76 | 88 |
| 2581 | 9398 | 700891526H1 | SOYMON024 | g2570066 | BLASTN | 868 | 1e−63 | 87 |
| 2582 | 14740 | LIB3051-038-Q1-K1-E10 | LIB3051 | g2570066 | BLASTN | 1331 | 1e−102 | 86 |
| 2583 | 31182 | LIB3051-015-Q1-E1-F1 | LIB3051 | g2570066 | BLASTN | 1540 | 1e−119 | 88 |
| 2584 | 318 | LIB3050-024-Q1-K1-H5 | LIB3050 | g2606080 | BLASTN | 1736 | 1e−135 | 95 |
| 2585 | 318 | LIB3050-012-Q1-E1-F10 | L1B3050 | g2606080 | BLASTN | 1564 | 1e−125 | 98 |
| 2586 | 318 | LIB3056-013-Q1-N1-H11 | LIB3056 | g3169543 | BLASTN | 1617 | 1e−125 | 86 |
| 2587 | 318 | LIB3028-026-Q1-B1-F6 | LIB3028 | g3169543 | BLASTN | 1393 | 1e−107 | 84 |
| 2588 | 318 | LIB3049-031-Q1-E1-B6 | LIB3049 | g3169543 | BLASTN | 1290 | 1e−98 | 90 |
| 2589 | 33428 | LIB3051-085-Q1-K1-D11 | LIB3051 | g2570066 | BLASTN | 679 | 1e−53 | 86 |
| 2590 | 869 | LIB3056-014-Q1-N1-G8 | LIB3056 | g2606080 | BLASTN | 1503 | 1e−132 | 96 |
| SOYBEAN HEXOKINASE | | | | | | | | |
| 2591 | −700560085 | 700560085H1 | SOYMON001 | g1899024 | BLASTN | 456 | 1e−27 | 67 |
| 2592 | −700752579 | 700752579H1 | SOYMON014 | g836808 | BLASTX | 113 | 1e−8 | 54 |
| 2593 | −700753182 | 700753182H1 | SOYMON014 | g619928 | BLASTX | 234 | 1e−25 | 63 |
| 2594 | −700838622 | 700838622H1 | SOYMON020 | g619927 | BLASTN | 767 | 1e−55 | 78 |
| 2595 | −700840271 | 700840271H1 | SOYMON020 | g619927 | BLASTN | 525 | 1e−34 | 67 |
| 2596 | −700844132 | 700844132H1 | SOYMON021 | g619927 | BLASTN | 474 | 1e−51 | 77 |
| 2597 | −700898308 | 700898308H1 | SOYMON027 | g619927 | BLASTN | 464 | 1e−29 | 72 |
| 2598 | −700904279 | 700904279H1 | SOYMON022 | g881521 | BLASTX | 129 | 1e−10 | 67 |
| 2599 | −700904320 | 700904320H1 | SOYMON022 | g1899024 | BLASTN | 612 | 1e−42 | 71 |
| 2600 | −700946357 | 700946357H1 | SOYMON024 | g619928 | BLASTX | 112 | 1e−18 | 69 |

TABLE A*-continued

| Seq No. | Cluster ID | CloneID | Library | NCBI gi | Method | Score | P-value | % Ident |
|---|---|---|---|---|---|---|---|---|
| 2601 | -700998007 | 700998007H1 | SOYMON018 | g1899024 | BLASTN | 367 | 1e-20 | 71 |
| 2602 | -701097096 | 701097096H1 | SOYMON028 | g619927 | BLASTN | 488 | 1e-30 | 73 |
| 2603 | -701102877 | 701102877H1 | SOYMON028 | g619927 | BLASTN | 551 | 1e-37 | 70 |
| 2604 | -701103285 | 701103285H1 | SOYMON028 | g619928 | BLASTX | 179 | 1e-17 | 77 |
| 2605 | -701105838 | 701105838H1 | SOYMON036 | g619928 | BLASTX | 274 | 1e-30 | 63 |
| 2606 | -701138291 | 701138291H1 | SOYMON038 | g619927 | BLASTN | 819 | 1e-59 | 79 |
| 2607 | 12404 | 701065794H1 | SOYMON034 | g3087888 | BLASTX | 84 | 1e-11 | 44 |
| 2608 | 12404 | 701131030H1 | SOYMON038 | g1899025 | BLASTX | 120 | 1e-9 | 45 |
| 2609 | 12693 | 700846513H1 | SOYMON021 | g619927 | BLASTN | 459 | 1e-28 | 70 |
| 2610 | 12693 | 700656744H1 | SOYMON004 | g619927 | BLASTN | 251 | 1e-10 | 57 |
| 2611 | 12917 | 700906858H1 | SOYMON022 | g3087888 | BLASTX | 183 | 1e-32 | 80 |
| 2612 | 12917 | 700830011H1 | SOYMON019 | g619927 | BLASTN | 495 | 1e-32 | 70 |
| 2613 | 12917 | 701068501H1 | SOYMON034 | g619927 | BLASTN | 475 | 1e-29 | 72 |
| 2614 | 12917 | 701153981H1 | SOYMON031 | g3087887 | BLASTX | 440 | 1e-26 | 69 |
| 2615 | 222 | 700663332H1 | SOYMON005 | g619927 | BLASTN | 724 | 1e-51 | 76 |
| 2616 | 222 | 701142003H1 | SOYMON038 | g881520 | BLASTN | 542 | 1e-39 | 72 |
| 2617 | 222 | 700657213H1 | SOYMON004 | g881520 | BLASTN | 524 | 1e-34 | 73 |
| 2618 | 222 | 700833679H1 | SOYMON019 | g1899024 | BLASTN | 453 | 1e-28 | 80 |
| 2619 | 222 | 700556060H1 | SOYMON001 | g619927 | BLASTN | 463 | 1e-28 | 82 |
| 2620 | 23610 | 700984359H1 | SOYMON009 | g1899024 | BLASTN | 611 | 1e-42 | 73 |
| 2621 | 23610 | 701003284H1 | SOYMON019 | g1899024 | BLASTN | 577 | 1e-39 | 75 |
| 2622 | 25188 | 700760643H1 | SOYMON015 | g619927 | BLASTN | 701 | 1e-49 | 73 |
| 2623 | 25188 | 701056127H1 | SOYMON032 | g1899024 | BLASTN | 649 | 1e-45 | 70 |
| 2624 | 27316 | 701054167H1 | SOYMON032 | g3087888 | BLASTX | 177 | 1e-17 | 47 |
| 2625 | 27316 | 701054157H1 | SOYMON032 | g3087888 | BLASTX | 177 | 1e-17 | 47 |
| 2626 | 488 | 700682650H2 | SOYMON008 | g687676 | BLASTN | 730 | 1e-52 | 77 |
| 2627 | 488 | 700849894H1 | SOYMON021 | g687676 | BLASTN | 582 | 1e-39 | 76 |
| 2628 | -GM32703 | LIB3051-008-Q1-E1-C12 | LIB3051 | g1899024 | BLASTN | 981 | 1e-76 | 77 |
| 2629 | -GM9523 | LIB3049-003-Q1-E1-A6 | LIB3049 | g619928 | BLASTX | 203 | 1e-37 | 64 |
| 2630 | 12693 | LIB3051-106-Q1-K1-A9 | LIB3051 | g619927 | BLASTN | 459 | 1e-38 | 71 |
| 2631 | 488 | L1B3040-006-Q1-E1-A12 | L1B3040 | g687676 | BLASTN | 622 | 1e-41 | 76 |
| 2632 | 488 | LIB3053-008-Q1-N1-C6 | LIB3053 | g687676 | BLASTN | 597 | 1e-39 | 75 |
| 2633 | 488 | LIB3055-008-Q1-N1-F5 | LIB3055 | g687676 | BLASTN | 559 | 1e-36 | 75 |
| 2634 | 488 | LIB3053-010-Q1-N1-D8 | LIB3053 | g687676 | BLASTN | 514 | 1e-32 | 75 |
| | | | SOYBEAN FRUCTOKINASE | | | | | |
| 2635 | -700834049 | 700834049H1 | SOYMON019 | g1915974 | BLASTX | 112 | 1e-10 | 97 |
| 2636 | -700905716 | 700905716H1 | SOYMON022 | g1915973 | BLASTN | 774 | 1e-55 | 77 |
| 2637 | -700978126 | 700978126H1 | SOYMON009 | g1915973 | BLASTN | 565 | 1e-38 | 77 |
| 2638 | -700983171 | 700983171H1 | SOYMON009 | g1915974 | BLASTX | 96 | 1e-9 | 93 |
| 2639 | -701069652 | 701069652H1 | SOYMON034 | g297014 | BLASTN | 447 | 1e-27 | 73 |
| 2640 | -701118004 | 701118004H2 | SOYMON037 | g2102690 | BLASTN | 440 | 1e-26 | 73 |
| 2641 | -701209270 | 701209270H1 | SOYMON035 | g1052972 | BLASTN | 648 | 1e-45 | 79 |
| 2642 | 1174 | 700832430H1 | SOYMON019 | g1915973 | BLASTN | 638 | 1e-44 | 81 |
| 2643 | 1174 | 701101576H1 | SOYMON028 | g1915973 | BLASTN | 592 | 1e-40 | 79 |
| 2644 | 1174 | 700754333H1 | SOYMON014 | g1915973 | BLASTN | 323 | 1e-37 | 80 |
| 2645 | 1174 | 701004323H1 | SOYMON019 | g297014 | BLASTN | 560 | 1e-37 | 80 |
| 2646 | 1174 | 700988192H1 | SOYMON009 | g1915973 | BLASTN | 508 | 1e-33 | 78 |
| 2647 | 1174 | 700646337H1 | SOYMON013 | g1915974 | BLASTX | 153 | 1e-30 | 79 |
| 2648 | 1174 | 701039647H1 | SOYMON029 | g1915973 | BLASTN | 275 | 1e-12 | 80 |
| 2649 | 16472 | 701155250H1 | SOYMON031 | g1915973 | BLASTN | 642 | 1e-50 | 78 |
| 2650 | 16472 | 700953304H1 | SOYMON022 | g1915973 | BLASTN | 690 | 1e-48 | 79 |
| 2651 | 16472 | 700725996H1 | SOYMON009 | g1915973 | BLASTN | 362 | 1e-28 | 73 |
| 2652 | 17936 | 700965277H1 | SOYMON022 | g2102690 | BLASTN | 375 | 1e-42 | 77 |
| 2653 | 17936 | 700746240H1 | SOYMON013 | g2102690 | BLASTN | 606 | 1e-41 | 74 |
| 2654 | 22120 | 701215393H1 | SOYMON035 | g2102691 | BLASTX | 133 | 1e-11 | 86 |
| 2655 | 22586 | 701009695H1 | SOYMON019 | g2102690 | BLASTN | 696 | 1e-49 | 76 |
| 2656 | 22586 | 700900731H1 | SOYMON027 | g2102690 | BLASTN | 422 | 1e-26 | 76 |
| 2657 | 23551 | 701053585H1 | SOYMON032 | g2102691 | BLASTX | 120 | 1e-9 | 92 |
| 2658 | 28587 | 701156878H1 | SOYMON031 | g2102690 | BLASTN | 448 | 1e-33 | 72 |
| 2659 | 3876 | 700942858H1 | SOYMON024 | g297014 | BLASTN | 705 | 1e-49 | 74 |
| 2660 | 3876 | 701063105H1 | SOYMON033 | g1052972 | BLASTN | 679 | 1e-47 | 73 |
| 2661 | 3876 | 700844831H1 | SOYMON021 | g1915973 | BLASTN | 466 | 1e-37 | 72 |
| 2662 | 5530 | 700733713H1 | SOYMON010 | g1915974 | BLASTX | 156 | 1e-26 | 81 |
| 2663 | 5530 | 701057239H1 | SOYMON033 | g1915974 | BLASTX | 176 | 1e-17 | 92 |
| 2664 | 5530 | 700985231H1 | SOYMON009 | g297014 | BLASTN | 222 | 1e-16 | 79 |
| 2665 | 5805 | 701010614H1 | SOYMON019 | g1915973 | BLASTN | 958 | 1e-71 | 80 |
| 2666 | 5805 | 701003106H1 | SOYMON019 | g1915973 | BLASTN | 679 | 1e-64 | 81 |
| 2667 | 5805 | 700748895H1 | SOYMON013 | g1915973 | BLASTN | 475 | 1e-55 | 83 |
| 2668 | 5805 | 700892801H1 | SOYMON024 | g1915973 | BLASTN | 639 | 1e-55 | 80 |

TABLE A*-continued

| Seq No. | Cluster ID | CloneID | Library | NCBI gi | Method | Score | P-value | % Ident |
|---|---|---|---|---|---|---|---|---|
| 2669 | 5805 | 700891914H1 | SOYMON024 | g1915973 | BLASTN | 639 | 1e−55 | 81 |
| 2670 | 5805 | 700962529H1 | SOYMON022 | g1915973 | BLASTN | 622 | 1e−54 | 82 |
| 2671 | 5805 | 700869294H1 | SOYMON016 | g1915973 | BLASTN | 760 | 1e−54 | 80 |
| 2672 | 5805 | 700986530H1 | SOYMON009 | g1915973 | BLASTN | 761 | 1e−54 | 80 |
| 2673 | 5805 | 700661115H1 | SOYMON005 | g1915973 | BLASTN | 682 | 1e−48 | 78 |
| 2674 | 5805 | 701041987H1 | SOYMON029 | g297014 | BLASTN | 475 | 1e−45 | 83 |
| 2675 | 5805 | 701006803H1 | SOYMON019 | g1915973 | BLASTN | 607 | 1e−41 | 80 |
| 2676 | 28587 | LIB3028-008-Q1-B1-H3 | LIB3028 | g2102690 | BLASTN | 900 | 1e−66 | 68 |
| 2677 | 5530 | LIB3055-004-Q1-N1-H3 | LIB3055 | g297014 | BLASTN | 606 | 1e−39 | 76 |
| 2678 | 5805 | LIB3065-006-Q1-N1-F11 | LIB3065 | g1915973 | BLASTN | 954 | 1e−81 | 79 |
| SOYBEAN NDP-KINASE | | | | | | | | |
| 2679 | 33331 | 701108520H1 | SOYMON036 | g758643 | BLASTN | 473 | 1e−31 | 75 |
| 2680 | 23595 | LIB3050-018-Q1-E1-C4 | LIB3050 | g758643 | BLASTN | 295 | 1e−13 | 76 |
| 2681 | 33331 | LIB3040-037-Q1-E1-D6 | LIB3040 | g758643 | BLASTN | 413 | 1e−47 | 79 |
| SOYBEAN GLUCOSE-6-PHOSPHATE 1-DEHYDROGENASE | | | | | | | | |
| 2682 | −700869140 | 700869140H1 | SOYMON016 | g2829880 | BLASTX | 164 | 1e−15 | 44 |
| 2683 | −701065174 | 701065174H1 | SOYMON034 | g603219 | BLASTX | 86 | 1e−9 | 76 |
| 2684 | −701130434 | 701130434H1 | SOYMON037 | g1197385 | BLASTX | 189 | 1e−19 | 55 |
| 2685 | −701149522 | 701149522H1 | SOYMON031 | g603219 | BLASTX | 99 | 1e−8 | 71 |
| 2686 | 26484 | 701003905H1 | SOYMON019 | g1197385 | BLASTX | 138 | 1e−15 | 81 |
| 2687 | 9136 | 701038169H1 | SOYMON029 | g603219 | BLASTX | 139 | 1e−21 | 73 |
| 2688 | 9136 | 700903571H1 | SOYMON022 | g603219 | BLASTX | 144 | 1e−20 | 81 |
| 2689 | 9136 | 701045122H1 | SOYMON032 | g603219 | BLASTX | 100 | 1e−13 | 79 |
| SOYBEAN PHOSPHOGLUCOMUTASE | | | | | | | | |
| 2690 | −700554424 | 700554424H1 | SOYMON001 | g534982 | BLASTX | 133 | 1e−25 | 60 |
| 2691 | −700556670 | 700556670H1 | SOYMON001 | g3294468 | BLASTN | 355 | 1e−43 | 74 |
| 2692 | −700563871 | 700563871H1 | SOYMON002 | g2795876 | BLASTX | 101 | 1e−16 | 75 |
| 2693 | −700565101 | 700565101H1 | SOYMON002 | g3294466 | BLASTN | 588 | 1e−40 | 68 |
| 2694 | −700566749 | 700566749H1 | SOYMON002 | g1814400 | BLASTN | 475 | 1e−41 | 73 |
| 2695 | −700681382 | 700681382H2 | SOYMON008 | g3294467 | BLASTX | 98 | 1e−11 | 48 |
| 2696 | −700763827 | 700763827H1 | SOYMON018 | g3192042 | BLASTX | 257 | 1e−29 | 60 |
| 2697 | −700865583 | 700865583H1 | SOYMON016 | g3192042 | BLASTX | 134 | 1e−17 | 57 |
| 2698 | −700891379 | 700891379H1 | SOYMON024 | g534982 | BLASTX | 167 | 1e−15 | 53 |
| 2699 | −700942816 | 700942816H1 | SOYMON024 | g3294466 | BLASTN | 636 | 1e−44 | 74 |
| 2700 | −701004954 | 701004954H1 | SOYMON019 | g1814400 | BLASTN | 790 | 1e−56 | 78 |
| 2701 | −701011364 | 701011364H1 | SOYMON019 | g534982 | BLASTX | 284 | 1e−32 | 67 |
| 2702 | −701057063 | 701057063H2 | SOYMON033 | g1814401 | BLASTX | 121 | 1e−9 | 60 |
| 2703 | −701119491 | 701119491H1 | SOYMON037 | g1814400 | BLASTN | 762 | 1e−54 | 76 |
| 2704 | −701149254 | 701149254H1 | SOYMON031 | g534982 | BLASTX | 147 | 1e−19 | 52 |
| 2705 | 10032 | 700988921H1 | SOYMON011 | g1814400 | BLASTN | 908 | 1e−66 | 80 |
| 2706 | 10032 | 701136003H1 | SOYMON038 | g1814400 | BLASTN | 842 | 1e−61 | 78 |
| 2707 | 10032 | 700953253H1 | SOYMON022 | g1814400 | BLASTN | 808 | 1e−58 | 77 |
| 2708 | 10032 | 701103083H1 | SOYMON028 | g1814400 | BLASTN | 813 | 1e−58 | 78 |
| 2709 | 10131 | 701104852H1 | SOYMON036 | g3294466 | BLASTN | 302 | 1e−27 | 74 |
| 2710 | 10131 | 700970420H1 | SOYMON005 | g2829893 | BLASTX | 240 | 1e−26 | 56 |
| 2711 | 1180 | 701125681H1 | SOYMON037 | g2829893 | BLASTX | 163 | 1e−15 | 82 |
| 2712 | 1180 | 700559947H1 | SOYMON001 | g2829893 | BLASTX | 163 | 1e−15 | 82 |
| 2713 | 1180 | 700556009H1 | SOYMON001 | g2829893 | BLASTX | 102 | 1e−14 | 87 |
| 2714 | 13262 | 701006086H2 | SOYMON019 | g3294466 | BLASTN | 734 | 1e−52 | 75 |
| 2715 | 13262 | 701137937H1 | SOYMON038 | g3294466 | BLASTN | 491 | 1e−32 | 71 |
| 2716 | 13262 | 701004207H1 | SOYMON019 | g3294466 | BLASTN | 271 | 1e−30 | 75 |
| 2717 | 13262 | 700904551H1 | SOYMON022 | g3294466 | BLASTN | 473 | 1e−30 | 75 |
| 2718 | 13262 | 701014357H1 | SOYMON019 | g1814401 | BLASTX | 210 | 1e−21 | 83 |
| 2719 | 13262 | 701146638H1 | SOYMON031 | g1814401 | BLASTX | 111 | 1e−20 | 80 |
| 2720 | 13262 | 700833416H1 | SOYMON019 | g1814400 | BLASTN | 374 | 1e−20 | 74 |
| 2721 | 13262 | 701148967H1 | SOYMON031 | g1814401 | BLASTX | 194 | 1e−19 | 82 |
| 2722 | 13262 | 701156042H1 | SOYMON031 | g1814401 | BLASTX | 182 | 1e−18 | 67 |
| 2723 | 13262 | 700943365H1 | SOYMON024 | g1814401 | BLASTX | 168 | 1e−16 | 76 |
| 2724 | 13262 | 701105762H1 | SOYMON036 | g1814401 | BLASTX | 165 | 1e−15 | 83 |
| 2725 | 13262 | 701038338H1 | SOYMON029 | g1814401 | BLASTN | 186 | 1e−13 | 77 |
| 2726 | 13262 | 700645989H1 | SOYMON011 | g1814401 | BLASTX | 133 | 1e−11 | 78 |
| 2727 | 13262 | 700868941H1 | SOYMON016 | g1814400 | BLASTN | 181 | 1e−9 | 80 |
| 2728 | 19312 | 701121150H1 | SOYMON037 | g3294468 | BLASTN | 501 | 1e−61 | 79 |
| 2729 | 19312 | 700742959H1 | SOYMON012 | g3294468 | BLASTN | 440 | 1e−45 | 83 |
| 2730 | 19312 | 701135418H1 | SOYMON038 | g3294468 | BLASTN | 459 | 1e−42 | 79 |
| 2731 | 19312 | 700979514H2 | SOYMON009 | g1814400 | BLASTN | 612 | 1e−42 | 78 |
| 2732 | 19883 | 701133631H2 | SOYMON038 | g1814400 | BLASTN | 758 | 1e−54 | 75 |
| 2733 | 19883 | 700970758H1 | SOYMON005 | g1814400 | BLASTN | 717 | 1e−50 | 77 |
| 2734 | 19883 | 701153416H1 | SOYMON031 | g1814400 | BLASTN | 691 | 1e−48 | 76 |

TABLE A*-continued

| Seq No. | Cluster ID | CloneID | Library | NCBI gi | Method | Score | P-value | % Ident |
|---|---|---|---|---|---|---|---|---|
| 2735 | 26278 | 701214005H1 | SOYMON035 | g534982 | BLASTX | 118 | 1e−8 | 47 |
| 2736 | −GM1647 | LIB3028-009-Q1-B1-F3 | LIB3028 | g534982 | BLASTX | 192 | 1e−42 | 57 |
| 2737 | −GM17162 | LIB3055-012-Q1-N1-B3 | LIB3055 | g1814400 | BLASTN | 491 | 1e−29 | 62 |
| 2738 | 13262 | LIB3028-003-Q1-B1-B11 | LIB3028 | g1814400 | BLASTN | 1069 | 1e−80 | 76 |
| 2739 | 13262 | LIB3054-009-Q1-N1-A12 | LIB3054 | g1814400 | BLASTN | 612 | 1e−40 | 73 |
| 2740 | 13262 | LIB3054-009-Q1-N1-A5 | LIB3054 | g1814401 | BLASTX | 200 | 1e−36 | 73 |
| SOYBEAN UDP-GLUCOSE PYROPHOSPHORYLASE | | | | | | | | |
| 2741 | −700665357 | 700665357H1 | SOYMON005 | g1388021 | BLASTX | 183 | 1e−18 | 69 |
| 2742 | −700674325 | 700674325H1 | SOYMON007 | g218000 | BLASTN | 645 | 1e−44 | 72 |
| 2743 | −700835903 | 700835903H1 | SOYMON019 | g1388021 | BLASTX | 135 | 1e−11 | 68 |
| 2744 | −700841466 | 700841466H1 | SOYMON020 | g1388021 | BLASTX | 115 | 1e−14 | 56 |
| 2745 | −700846570 | 700846570H1 | SOYMON021 | g3107930 | BLASTN | 486 | 1e−31 | 70 |
| 2746 | −700888547 | 700888547H1 | SOYMON024 | g3107930 | BLASTN | 582 | 1e−39 | 81 |
| 2747 | −700973436 | 700973436H1 | SOYMON005 | g1212996 | BLASTX | 132 | 1e−15 | 51 |
| 2748 | −700985779 | 700985779H1 | SOYMON009 | g3107930 | BLASTN | 958 | 1e−71 | 83 |
| 2749 | −700992994 | 700992994H1 | SOYMON011 | g1388021 | BLASTX | 103 | 1e−10 | 64 |
| 2750 | −701061122 | 701061122H1 | SOYMON033 | g1388021 | BLASTX | 129 | 1e−19 | 73 |
| 2751 | −701063465 | 701063465H1 | SOYMON033 | g3107930 | BLASTN | 426 | 1e−62 | 82 |
| 2752 | −701118256 | 701118256H1 | SOYMON037 | g3107930 | BLASTN | 378 | 1e−31 | 83 |
| 2753 | 11810 | 700952705H1 | SOYMON022 | g3107930 | BLASTN | 613 | 1e−54 | 80 |
| 2754 | 11810 | 701060568H1 | SOYMON033 | g3107930 | BLASTN | 652 | 1e−45 | 81 |
| 2755 | 11810 | 701002783H2 | SOYMON019 | g3107930 | BLASTN | 458 | 1e−43 | 80 |
| 2756 | 11810 | 701202674H1 | SOYMON035 | g218000 | BLASTN | 331 | 1e−33 | 73 |
| 2757 | 11810 | 700871590H1 | SOYMON018 | g218000 | BLASTN | 326 | 1e−27 | 76 |
| 2758 | 11810 | 700747279H1 | SOYMON013 | g1388021 | BLASTX | 154 | 1e−21 | 75 |
| 2759 | 11810 | 701014424H1 | SOYMON019 | g1388021 | BLASTX | 131 | 1e−20 | 84 |
| 2760 | 11810 | 701039454H1 | SOYMON029 | g1388021 | BLASTX | 157 | 1e−16 | 80 |
| 2761 | 11810 | 701054271H1 | SOYMON032 | g1388021 | BLASTX | 154 | 1e−15 | 71 |
| 2762 | 11810 | 700955092H1 | SOYMON022 | g1388021 | BLASTX | 154 | 1e−14 | 71 |
| 2763 | 11810 | 701107189H1 | SOYMON036 | g1388021 | BLASTX | 155 | 1e−14 | 72 |
| 2764 | 11810 | 701107930H1 | SOYMON036 | g218000 | BLASTN | 308 | 1e−14 | 75 |
| 2765 | 11810 | 700904384H1 | SOYMON022 | g1388021 | BLASTX | 149 | 1e−13 | 72 |
| 2766 | 11810 | 700729516H1 | SOYMON009 | g1388021 | BLASTX | 155 | 1e−13 | 72 |
| 2767 | 11810 | 701009325H1 | SOYMON019 | g1388021 | BLASTX | 143 | 1e−12 | 75 |
| 2768 | 11821 | 701060627H1 | SOYMON033 | g218000 | BLASTN | 253 | 1e−26 | 74 |
| 2769 | 11821 | 701004671H1 | SOYMON019 | g21599 | BLASTX | 166 | 1e−22 | 77 |
| 2770 | 11821 | 700964889H1 | SOYMON022 | g1388021 | BLASTX | 167 | 1e−16 | 67 |
| 2771 | 13178 | 700562308H1 | SOYMON002 | g3107930 | BLASTN | 1198 | 1e−91 | 87 |
| 2772 | 13178 | 701049018H1 | SOYMON032 | g3107930 | BLASTN | 1101 | 1e−82 | 88 |
| 2773 | 13178 | 701126215H1 | SOYMON037 | g3107930 | BLASTN | 1072 | 1e−80 | 88 |
| 2774 | 13178 | 701211745H1 | SOYMON035 | g3107930 | BLASTN | 1038 | 1e−77 | 87 |
| 2775 | 13178 | 700850417H1 | SOYMON023 | g3107930 | BLASTN | 1022 | 1e−76 | 87 |
| 2776 | 13178 | 700665292H1 | SOYMON005 | g3107930 | BLASTN | 980 | 1e−72 | 88 |
| 2777 | 13178 | 700994009H1 | SOYMON011 | g3107930 | BLASTN | 958 | 1e−71 | 86 |
| 2778 | 13178 | 700895203H1 | SOYMON024 | g3107930 | BLASTN | 864 | 1e−68 | 86 |
| 2779 | 13178 | 701151725H1 | SOYMON031 | g3107930 | BLASTN | 800 | 1e−66 | 87 |
| 2780 | 13178 | 700988803H1 | SOYMON011 | g3107930 | BLASTN | 896 | 1e−65 | 80 |
| 2781 | 13178 | 700646581H1 | SOYMON014 | g3107930 | BLASTN | 483 | 1e−62 | 81 |
| 2782 | 13178 | 701153726H1 | SOYMON031 | g3107930 | BLASTN | 832 | 1e−60 | 87 |
| 2783 | 13178 | 701152333H1 | SOYMON031 | g3107930 | BLASTN | 674 | 1e−56 | 79 |
| 2784 | 13178 | 700756960H1 | SOYMON015 | g3107930 | BLASTN | 787 | 1e−56 | 86 |
| 2785 | 13178 | 700556901H1 | SOYMON001 | g218000 | BLASTN | 772 | 1e−55 | 84 |
| 2786 | 13178 | 701063605H1 | SOYMON033 | g3107930 | BLASTN | 566 | 1e−51 | 89 |
| 2787 | 13178 | 701212385H1 | SOYMON035 | g3107930 | BLASTN | 390 | 1e−23 | 78 |
| 2788 | 13178 | 700889518H1 | SOYMON024 | g3107931 | BLASIX | 131 | 1e−10 | 64 |
| 2789 | 17057 | 700740176H1 | SOYMON012 | g3107930 | BLASTN | 798 | 1e−57 | 81 |
| 2790 | 17057 | 700905747H1 | SOYMON022 | g3107930 | BLASTN | 511 | 1e−33 | 81 |
| 2791 | 1955 | 701059208H1 | SOYMON033 | g3107930 | BLASTN | 1034 | 1e−77 | 85 |
| 2792 | 1955 | 700984109H1 | SOYMON009 | g3107930 | BLASTN | 970 | 1e−72 | 84 |
| 2793 | 1955 | 701209482H1 | SOYMON035 | g3107930 | BLASTN | 931 | 1e−68 | 84 |
| 2794 | 1955 | 700554847H1 | SOYMON001 | g3107930 | BLASTN | 493 | 1e−66 | 83 |
| 2795 | 1955 | 701150363H1 | SOYMON031 | g3107930 | BLASTN | 898 | 1e−66 | 84 |
| 2796 | 1955 | 700986014H1 | SOYMON009 | g3107930 | BLASTN | 907 | 1e−66 | 84 |
| 2797 | 1955 | 700564270H1 | SOYMON002 | g3107930 | BLASTN | 501 | 1e−65 | 84 |
| 2798 | 1955 | 700844253H1 | SOYMON021 | g3107930 | BLASTN | 875 | 1e−64 | 84 |
| 2799 | 1955 | 701140892H1 | SOYMON038 | g3107930 | BLASTN | 879 | 1e−64 | 83 |
| 2800 | 1955 | 700685893H1 | SOYMON008 | g3107930 | BLASTN | 832 | 1e−60 | 81 |
| 2801 | 1955 | 700789732H1 | SOYMON011 | g3107930 | BLASTN | 554 | 1e−57 | 84 |
| 2802 | 1955 | 700902418H1 | SOYMON027 | g3107930 | BLASTN | 731 | 1e−52 | 83 |
| 2803 | 1955 | 701128306H1 | SOYMON037 | g3107930 | BLASTN | 466 | 1e−46 | 82 |
| 2804 | 1955 | 701057973H1 | SOYMON033 | g3107930 | BLASTN | 422 | 1e−43 | 78 |

TABLE A*-continued

| Seq No. | Cluster ID | CloneID | Library | NCBI gi | Method | Score | P-value | % Ident |
|---|---|---|---|---|---|---|---|---|
| 2805 | 21035 | 700946288H1 | SOYMON024 | g3107931 | BLASTX | 175 | 1e−17 | 72 |
| 2806 | 21035 | 701043539H1 | SOYMON029 | g3107931 | BLASTX | 147 | 1e−13 | 71 |
| 2807 | 30564 | 701063642H1 | SOYMON033 | g3107931 | BLASTX | 181 | 1e−25 | 75 |
| 2808 | −GM18453 | LIB3065-001-Q1-N1-H4 | LIB3065 | g1212996 | BLASTX | 68 | 1e−29 | 57 |
| 2809 | −GM32502 | LIB3051-013-Q1-E1-A6 | LIB3051 | g3107931 | BLASTX | 227 | 1e−47 | 51 |
| 2810 | 11810 | LIB3030-010-Q1-B1-H12 | LIB3030 | g21598 | BLASTN | 1115 | 1e−84 | 76 |
| 2811 | 13178 | LIB3056-014-Q1-N1-G7 | LIB3056 | g3107930 | BLASTN | 1145 | 1e−99 | 84 |
| 2812 | 1955 | LIB3056-012-Q1-N1-D4 | LIB3056 | g3107930 | BLASTN | 856 | 1e−62 | 80 |
| 2813 | 30564 | LIB3050-003-Q1-E1-D8 | LIB3050 | g3107930 | BLASTN | 1078 | 1e−81 | 74 |
| 2814 | 30564 | LIB3050-010-Q1-E1-D6 | LIB3050 | g3107930 | BLASTN | 1050 | 1e−78 | 75 |

*Table Headings

Cluster ID

A cluster ID is arbitrarily assigned to all of those clones which belong to the same cluster at a given stringency and a particular clone will belong to only one cluster at a given stringency. If a cluster contains only a single clone (a "singleton"), then the cluster ID number will be negative, with an absolute value equal to the clone ID number of its single member. The cluster-ID entries in the table refer to the cluster with which the particular clone in each row is associated.

Clone ID

The clone ID number refers to the particular clone in the PhytoSeq database. Each clone ID entry in the table refers to the clone whose sequence is used for (1) the sequence comparison whose scores are presented and/or (2) assignment to the particular cluster which is presented. Note that a clone may be included in this table even if its sequence comparison scores fail to meet the minimum standards for similarity. In such a case, the clone is included due solely to its association with a particular cluster for which sequences of one or more other member clones possess the required level of similarity.

Library

The library ID refers to the particular cDNA library from which a given clone is obtained. Each cDNA library is associated with the particular tissue(s), line(s) and developmental stage(s) from which it is isolated.

NCBI gi

Each sequence in the GenBank public database is arbitrarily assigned a unique NCBI gi (National Center for Biotechnology Information GenBank Identifier) number. In this table, the NCBI gi number which is associated (in the same row) with a given clone refers to the particular GenBank sequence which is used in the sequence comparison. This entry is omitted when a clone is included solely due to its association with a particular cluster.

Method

The entry in the "Method" column of the table refers to the type of BLAST search that is used for the sequence comparison. "CLUSTER" is entered when the sequence comparison scores for a given clone fail to meet the minimum values required for significant similarity. In such cases, the clone is listed in the table solely as a result of its association with a given cluster for which sequences of one or more other member clones possess the required level of similarity.

Score

Each entry in the "Score" column of the table refers to the BLAST score that is generated by sequence comparison of the designated clone with the designated GenBank sequence using the designated BLAST method. This entry is omitted when a clone is included solely due to its association with a particular cluster. If the program used to determine the hit is HMMSW then the score refers to HMMSW score.

P-Value

The entries in the P-Value column refer to the probability that such matches occur by chance.

% Ident

The entries in the "% Ident" column of the table refer to the percentage of identically matched nucleotides (or residues) that exist along the length of that portion of the sequences which is aligned by the BLAST comparison to generate the statistical scores presented. This entry is omitted when a clone is included solely due to its association with a particular cluster.

SEQUENCE LISTING (2814 sequences)

SEQ ID NO: 1 - DNA, 234 bp, Zea mays
ttttgatgtatgttttaggcagaagaaggcttttgcaggtgaaacttcttcatcttaagaagttcatgctgctgtacgcaattggctgaagaccaacatatcacacgatgttgcttctagcactcgaataatctatggaggctctgttcaaggataagaagccagtcaaggtcatcaagaagaactcggctgcagtcaccaagttcctcgatgagctggctaagattggccgca

SEQ ID NO: 2 - DNA, 303 bp, Zea mays
gtgcctctttgaagggccctgatttcgccaccattatcaactcggtgaccgctaagaaagttgcagcctgatgagccctgtctgttagaaataagtagtcatctgtgtttcaacctcacctgccacgccgtaaagcctgtaggaggtgatccgtgtgatggtgtgccgtcaccttcctgcctttgctgatttgcaacaccacggaaacagaaaataacgcaagatgtcacattttttttgttctcgtagtccgtagaccttgtgtacgttacgggagttcagttgcacgttggcgatgtacgt

SEQ ID NO: 3 - DNA, 232 bp, Zea mays
cacacgcgtccgcccacgcgtccgcggacgcgtggggtcaagaacgctgcatatgcattgagacaaaatgttaaggttattgcctgcataggcgagcttctggaagagagggaagcagggaaaacttttgaagtatgttttgagcagatgaaggcttttgcagatagtatttcgcactgggccgatgttgtgattgcatatgagcctgtttgggctattggaatcggtaaag

SEQ ID NO: 4 - DNA, 287 bp, Zea mays
gcatcgttgccatggctggatccggcaagttcttcgtcggaggcaactggaagtgcaatggaacaaaggactccattagcaaacttgtctctgaattgaatgctgctacccttgaaactgatgtagatgttgtggtggcacctccattcatctatattgttcaggttaagaattcactaactggtcgcattgaggtttctgctcagaatgtgtggattggaaaaggaggagcctacaccggagagatcagtgcagaacaactggtggacatcggctgtcaatgggtt

SEQ ID NO: 5 - DNA, 109 bp, Zea mays
gaaatccaatctagaagctcccctctccctccctccctctctctctctctcttcgccgtccgaagctccgcacccaatctaatcgacacctcaccgagatgggccgcaa

SEQ ID NO: 6 - DNA, 239 bp, Zea mays
gcaatccaatctagaagctcccctctccctccctccctctctctctctctcttcgccgtccgaagctccgcacgcaatctaatcgacacctcagcgagatgggccgcaagttcgtcgtcggtggcaactggaaatgcaatggaaccacagatcaggtcgagaagattgtcaaaaccctgaatgaaggacaagttccccttcagatgtgctcgaggtcgttgtcaaccctccttatgtcg

SEQ ID NO: 7 - DNA, 258 bp, Zea mays
  unsure (1)..(258): unsure at all n locations
caaggggctgctgcgcctggatttcgccgtcgcagcgcagaactgctgggtgcgcaagggcggcgccttcaccggcgagatcagtgctgagatgctggtacacctgcangtagcctgggtcatggtgacgacatctgagcgcagagctctgttgggtgaatcagtgatgtgctgctgatacagttcatatgcactcactcacgtctcaggtaatgctgcatcgtagaccttgacagaagagctgacaccatgatgtgt

SEQ ID NO: 8 - DNA, 98 bp, Zea mays
  unsure (1)..(98): unsure at all n locations
cgtgtcggcacaacactgttggagtcgcanaggtggtgcttataccggtgaggttagtgctgaaatgcttgttaatatgggaattccttgggttatta

SEQ ID NO: 9 - DNA, 253 bp, Zea mays
aatccacctcaatacatcttaatacacccaaaatgccgcgccaattcttcgtcggaggcaacttcaagatgaatggagtcactgactctatcaagtccatcgtctctaacatcaacaactccaagcgtgacccgtccaccgaagtcgtcatcgcccctcccgccatctatctcgcgctcacccgcgcacttgccgacccctcagtcggtgtctcggcccagaacgtctatgacaagcctagcggtgcttatac

SEQ ID NO: 10 - DNA, 290 bp, Zea mays
ggtaaacctgcaggtgccctgggtcattttgggacattctgagcgcagagctctgttgggtgaatccagtgattttgttgctgataaagttgcatatgcactcactcaaggtctcaaggtaattgcttgcattggtgagacccttgagcagagagaggcaggaacaacaatggatgttgttgctgcacaaacaaaggctattgctgaaaaaatatcagattggacaaatattgtgttggcatatgaaccagtttgggctattggtaccggcaaagttgcaactcctgctc

SEQ ID NO: 11 - DNA, 256 bp, Zea mays
tggtgaatccagtgattttgttgctgataaagttgcatatgcactcactcaaggtctcaaggtaattgcttgcattggtgagacccttgagcagagagacgcaggaacaacaatggatgttgttgctgcacaaacaaaggctattgctgaaaaaatatcagattggacaaatattgtgttggcatatgaaccagtttgggctattggtaccggcaaagttgcaattccggttcaggctcaggaggtccatgatggc

SEQ ID NO: 12 - DNA, 163 bp, Zea mays
ggtcaatcttcttggcctcacgatacttgcggagaaggcgcctcagcacacgcatcctcctcatccacagaaccttggtgggtagcctagcctccctggtacccctacgcttaccatatcctgagtggcgtcccttttgcttggcgtcatgtgcccttcttgc

SEQ ID NO: 13 - DNA, 310 bp, Zea mays
gctgcgccaagagttccatgttgctgctcagaactgccgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaaggactgg

SEQ ID NO: 14 - DNA, 297 bp, Zea mays
gtcaagagccagctgcgccaagagttccatgttgctgctcagaacttctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagca

SEQ ID NO: 15 - DNA, 305 bp, Zea mays
  unsure (1)..(305): unsure at all n locations
gagctctgctgggagaatcaaatgaatttgttggagacaaggttgcgtatgccctgtctcagggactaaaggtcattgcatgtgttggtgagacacttgagcagagggaggctgggtctaccatggaggttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctanagaccaacgtcagccctgaggtt

SEQ ID NO: 16 - DNA, 321 bp, Zea mays
cccacgcgtccggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacagcctgatgtcgatggttttcttgtcggtggagcttctttgaagcctgagttcatcgacatcatcaacgcggccaccgtgaagtccgcttaagatgctacgctgaagacgaacatactttttttttgctcaactgtgctatgtaagctagtagcttttg

SEQ ID NO: 17 - DNA, 285 bp, Zea mays
ctacggaggctctgtaactgctgcgaactgcaaagagctagcagcacagcctgatgtcgatggttttcttgtcggtggagcttctttgaagcctgagttcatcgacatcatcaacgcggccaccgtgaagtccgcttaagatgctacgctgaagacgaacatactttttttttgctcaactgtgctatgtaagctagtagcttttgcgcaggagcagagactgttttgcctgcccccaacttctagcttgagcttgctaataatgtttacctctggacgtatcaa

SEQ ID NO: 18 - DNA, 338 bp, Zea mays
ccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtca

SEQ ID NO: 19 - DNA, 298 bp, Zea mays
ggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaaggactggagcaacgtagttgttgcctatgaaccagtttgggctattggaactggtaaag

SEQ ID NO: 20 - DNA, 283 bp, Zea mays
gtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaaggactggagcaacgtagttgttgcctatgaaccagtttgggctattggaa

SEQ ID NO: 21 - DNA, 290 bp, Zea mays
ccttgagcagagggaggctgggtctaccatggatgttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacagcctgatgtcg

SEQ ID NO: 22 - DNA, 290 bp, Zea mays
cccacgcgtccggaactgctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaaggact

SEQ ID NO: 23 - DNA, 276 bp, Zea mays
cttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaaggactggagcaacgtagttgttgcctatgaaccagtttgggctattggaactggtaaagttgccaccccagctcaggctcaggaagtg

SEQ ID NO: 24 - DNA, 316 bp, Zea mays
cccacgcgtccgcatggatgttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacagcctgatgtcgatggttttcttgtcggtggagcttctttgaagcctgagttc

SEQ ID NO: 25 - DNA, 313 bp, Zea mays
  unsure (1)..(313): unsure at all n locations
cgcctcgctgagggattggctaaagaccaatgccagccctgaggttgctgaatctactaggatcatctacggaggctctgtaactgctgcgaactgcaaagagctagcagcacagcctgatgtcgatggttttcttgtcggtggagcttctttgaagcctgagttcatcgacatcatcaacgcggccaccgtgaagtccgcttaagatgctacgctgaagacgaacatactttttttttgctcaactgtgctatgtaagctagtagcttttgcgcaggagcagagactgttttgcctgcccnaacttctagct

SEQ ID NO: 26 - DNA, 277 bp, Zea mays
gctgctcagaactgctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaaga

SEQ ID NO: 27 - DNA, 268 bp, Zea mays
agggactaaaggtcattgcatgtgttggtgagacacttgagcagagggaggctgggtctaccatggaggttgttgctgcacaaacaaaagcaattgctgagaagatcaaggactggagcaacgtattgttgcctatgaaccagtttgggctattggaactggtaaagttgccaccccagctcaggctcaggaagtgcacgcctccctgagggattggctaaagaccaacgtcagccctgaggttgctgaatctactaggatcatttac

SEQ ID NO: 28 - DNA, 307 bp, Zea mays
gagaatcaaatgagtttgttggagacaaggttgcttttgctctgtctcagggactaaaggtcattgcatgtgttggtgagacccttgaggagagggaggctggttcaaccatggatgttgttgctgcacaaacaaaagcaattgctgagaagatcaaggactggagcaacgttgttcttgcctatgaaccagtctgggctattggaactggcaaagtcgccaccccagctcaggctcaggaagtgcacgcctccctgagggattgggtaaagatcaatgtcagccctgaggtctctgaatctacaag

SEQ ID NO: 29 - DNA, 285 bp, Zea mays
ggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttcgtgcacaaacaaaagcaattgctgagaagatcaaggactggagcaacgtagttgttgcctatgaaccagtttgggctattggaactggtaaagttgccaccccagctcaggctcaggaagtgcacgcctccctg

SEQ ID NO: 30 - DNA, 337 bp, Zea mays
aaaggtcattgcatgtgttggtgagacccttgagcagagggaggctgggtctaccatggatgttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacagcctgatgtcgatggttttcttgtcggtgga

SEQ ID NO: 31 - DNA, 302 bp, Zea mays
  unsure (1)..(302): unsure at all n locations
cccacgcgtccgcggacgcgtggggagtggnctcaccgagatgggccgcaagttcttcgtcggtggcaactggaaatgcaatggaaccacagatcaggtcgagaagattgtcaaaacactgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttg

SEQ ID NO: 32 - DNA, 256 bp, Zea mays
gccagctgcgccaagagttccatgttgctgctcagaactgctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtc

SEQ ID NO: 33 - DNA, 268 bp, Zea mays
cccacgcgtccggtgttggtgagacccttgagcagagggaggctgggtctaccatggatgttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctaaagaccaatgccagccctgaggttgctgaatctactaggatcatctacggaggctc

SEQ ID NO: 34 - DNA, 254 bp, Zea mays
ccatgttgctgctcagaactgctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttg

SEQ ID NO: 35 - DNA, 341 bp, Zea mays
cgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcatcttggacactctgaaag

SEQ ID NO: 36 - DNA, 251 bp, Zea mays
ttcggcacgagaaagagctagcagcacagcctgatgtcgatggttttcttgtcggtggagcttctttgaagcctgagttcatcgacatcatcaacgcggccaccgtgaagtccgcttaagatgctacgctgaagacgaacatactttttttttgctcaactgtgctatgtaagctagtagcttttgcgcaggagcagagactgttttgcctgcccccaacttctagcttgagcttgctaataatgtttacc

SEQ ID NO: 37 - DNA, 246 bp, Zea mays
tggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacagcctgatgtcgatggttttcttgtcggtggagcttctttgaagcctgagttcatcgacatcatcaacgcggccaccgtga

SEQ ID NO: 38 - DNA, 270 bp, Zea mays
ggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaggactggagcacgtattgttgcctatgaacca

SEQ ID NO: 39 - DNA, 277 bp, Zea mays
cgcagatcaggttgagaagattgtcaaaaccctgaatgaaggaaatgttccctcttcagatgttgttgaggttgttgtcagtcctccttatgtgttcctcccggtggtcaagagccagctgcgtcaagagttccaagttgctgctcagaactgctgggtgaagaagggaggtgcattcactggtgaaattagtgctgagatgctcgtcaaccttggcgttccctgggtcattcttggacactctgaaaggagagctctgctgggagaatcaaatgag

SEQ ID NO: 40 - DNA, 261 bp, Zea mays
cccacgcgtccggaactgctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaac

SEQ ID NO: 41 - DNA, 276 bp, Zea mays
tgaagggaggtgcattcaccggtgaaattagtgctgagatgctcgtcaaccttggcgttccctgggtcattcttggacactctgaaaggagagctctgctgggagaatcaaatgagtttgttggagacaaggttgcttttgctctgtctcagggactaaaggtcattgcatgtgttggtgagacccttgaggagagggaggctggttcaaccatggatgttgttgctgcacaaacaaaagcaattgctgagaagatcaaggactggagcaacgttg

SEQ ID NO: 42 - DNA, 326 bp, Zea mays
ccaatctagaagcacacctctccctctctctctcttcgccgtccgaagctccgcaccccaatctaatcgacacctcaccgagatgggccgcaagttcgtcgtcggtggcaactggaaatgcaatggaaccacagatcaggtcgagaagattgtcaaaaccctgaatgaaggacaggttcccccttcaatgttgtggaggtcgttgtcagccctccttatgtcttccttcctgtggtcaagagccagctgcgccaagagttccatgttgctgctcagaactgctgggtgaagaagggatgtgctttcactggtgaagtcatgctgag

SEQ ID NO: 43 - DNA, 244 bp, Zea mays
aactgcaaagagctagcagcacagcctgatgtcgatggttttcctgtcggtggagcttctttgaagcctgagttcatcgacatcatcaacgcggccaccgtgaagtccgcttaagatgctacgctgaagacgaacatactttttttttgctcaactgtgctatgtaagctagtagcttttgcgcaggagcagagactgttttgcctgcccccaacttctagcttgagcttgctaataatgttta

SEQ ID NO: 44 - DNA, 258 bp, Zea mays
cccacgcgtccgatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattct

SEQ ID NO: 45 - DNA, 265 bp, Zea mays
gaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttacaatgttgttgaggtcgttgtcagccctccttatgtcttccttcctgtggtcaagagccagctgcgccaagagttccatgttgctgctcagaactgctgggtgaagaagggaggtgctttcact

SEQ ID NO: 46 - DNA, 336 bp, Zea mays
aaggttgcgtatgccctgtctcagggactaaaggtcattgcatgtgttggtgagacccttgagcagagggaggctgggtctaccatggatgttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacag

SEQ ID NO: 47 - DNA, 349 bp, Zea mays
ctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttgg

SEQ ID NO: 48 - DNA, 317 bp, Zea mays
ccacgcgtccgaatcgacacccggccgacatgggccgcaagttcttcgttggtggcaactggaaacgcaatggaaccgcagaccaggttgagaagatcgtcaaaaccctgaatgaaggaaatgctccctcttcagacgtcgtcgaggttgttgtcagtcctcctcatgtgttcctcccggtggtcaagagccagctgcgccaagagttccaagtcgctgctcagaactgctgggtgaagaagggaggtgcattcactggtgaaaccagtgctgagatgctcgtcaaccttggcgtctccctgggtcactcttggaca

SEQ ID NO: 49 - DNA, 263 bp, Zea mays
ggaaatgcaatggaaccgcagatcaggttgagaagattgtcaaaaccctgaatgaaggaaatgttccctcttcagatgttgttgaggttgttgtcagtcctccttatgtgttcctcccggtggtcaagagccagctgcgccaagagttccaagttgctgctcagaactgctgggtgaagaagggaggtgcattcactggtgaaattagtgctgagatgctcgtcaaccttggcgttccctgggtcattcttggacactctgaa

SEQ ID NO: 50 - DNA, 227 bp, Zea mays
ctttgaagcctgagttcatcgacatcatcaacgcggccaccgtgaagtccgcttaagatgctacgctgaagacgaacatactttttttttgctcaactgtgctatgtaagctagtagcttttgcgcaggagcagagactgttttgcctgcccccaacttctagcttgagcttgctaataatgtttacctctggacgtatcaataatggtgcttatgtatcccctttt

SEQ ID NO: 51 - DNA, 300 bp, Zea mays
ccagtctgggctattggaactggcaaagtcgccaccccagctcaggctcaggaagtgcacgcctccctgagggattgggtaaagatcaatgtcagccctgaggtctctgaatctacaaggatcatctatggaggttcagtaactgctgcgaactgcaaagagctggcagcacagcctgatgtcgatggtttccttgtgggcggtgcttctttgaagcccgagttcatcgacatcatcaacgccgccaccgtgtgaagtccgcttaagatgttccaacccttcaccctgttgcggtgatgt

SEQ ID NO: 52 - DNA, 348 bp, Zea mays
ccgtactcaatctaatcgacacccggccgagattggacgcaatttcttcgttggtggcaactggaaatgcaatggaaccgcagatcaggttgagtagattgtcaagacgctgaatgaaggaaatgttccctcttcagatgttgttgaggttgtggtcagtcctccttatgtgttcctcccggtggtcaagagccagctgctccaagagttctaagttgctgctcagaactgctgggtgaagaagggaggtgcattcactggtgaaattagtgctgagatgctcgtcaaccttggcggtccctgggtcattcttggacactctgaaaggagagctctgtctgggagaat

SEQ ID NO: 53 - DNA, 264 bp, Zea mays
  unsure (1)..(264): unsure at all n locations
gtgagacccttgagcagagggaggctgggtctaccatggatgttgttnctgcacaaacaanagcaattgctgagaagatcaaggactggagcaacgtagttgttgcctatgaaccagtttgggctattggaactggtaaagttgccaccccagctcaggctcaggaagtgcacgcctccctgagggattggctaaagaccaatgccagccctggggttgctnantctataggntcntctanggggctttaaaaantgctgggaa

SEQ ID NO: 54 - DNA, 225 bp, Zea mays
gttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgctttcactggtgaagt

SEQ ID NO: 55 - DNA, 278 bp, Zea mays
  unsure (1)..(278): unsure at all n locations
cttggcgttccctgggtcattcttggacactctgcaaggagagctctgctgggagtttcctgtgagtttgttggagacaaggtttgtnttgctctgtctcagggactaaaggtcattgcatgtgttggtgagacccttgagtttagggaggctggttcaaccatggatgttgttgctgcacaaacaaaagcaattgctgagaagatcaaggactggagcaacgttgttcttgcctatgaaccagtctgggctattggaactggcaaagtcgccaccca

SEQ ID NO: 56 - DNA, 317 bp, Zea mays
gcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcactggtgaaattagtgctgaaatgctcgtcaaccttggcg

SEQ ID NO: 57 - DNA, 291 bp, Zea mays
ccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcactggtgaaattagtgctgaaatgctcgtcaacct

SEQ ID NO: 58 - DNA, 244 bp, Zea mays
acggaggctctgtaactgccgcgaactgcaaagagctagcagcacagcctgatgtcgatgggtttcttgtcggtggagcttctttgaagcctgagttcatcgacatcatcaacgcggccaccgtgaagtccgcttaagatggtacgcgtgagacgaacatactttttttttgctcaactgtgctatgtaagctagtagcttttggcgcaggacagagactttgtttacctcccccaacttttag

SEQ ID NO: 59 - DNA, 254 bp, Zea mays
ccatccgtacccaatctaatcgacacccggccgagatgggccgcaagttcttcgttggtggcaactggaaatgcaatggaaccacagatcaggttgagaagattgtcaaaaccctgaatgaaggaaatgttcctcttcagatgttgttgaggtcgttgtcagtcctccttatgtgttcctcccggtggtcaagagccagctgcgccaagagttccaagttgctgctcagaactgctgggtgaagaagggaggtg

SEQ ID NO: 60 - DNA, 222 bp, Zea mays
tgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaagg

SEQ ID NO: 61 - DNA, 263 bp, Zea mays
atcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggtgaagtcagtgctgag

SEQ ID NO: 62 - DNA, 292 bp, Zea mays
gaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgttgaggtcgttgtcagccctcttatgtcttccttcctgtggtcaagagccagctgcgccaagagttccatgttgctgctcagaactgctgggtgaagaagggaggtgctttcactggtgaagtcagtgctgagatgctcgtca

SEQ ID NO: 63 - DNA, 312 bp, Zea mays
ctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggtgaagtcagtgctgaga

SEQ ID NO: 64 - DNA, 259 bp, Zea mays
atccaatctagaagcacaccacaccctctctctctcttcgccgtccgaagcaccgcacaccaatctaatcgacacatcaccgagatgggccgcaagttcatcgtcggtagcaacaggaaatgcaatggaaccacagatcaggtcgagaagattgtcaaaacactgaatgaaggacaggttcccccatcagatgttgtggaggacgttgtcagcccaccttatgtcttccttcctgtggtcaagagccagcagcgccaag

SEQ ID NO: 65 - DNA, 295 bp, Zea mays
aagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggttgttgtcagtcctccttatgtgttcctcccggtggtcaagagccagctgcgccaagagttccaagttgctgctcagaactgctgggtgaagaagggaggtgcattcactggtgaaattag

SEQ ID NO: 66 - DNA, 320 bp, Zea mays
aaatccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggtgaa

SEQ ID NO: 67 - DNA, 207 bp, Zea mays
gcacgagctggagcaacgtagttgctgcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcac

SEQ ID NO: 68 - DNA, 265 bp, Zea mays
aatcgacacccggccgagatgggcgcaagttcttcgttggtggcaactggaaatgcaatggaaccgcagatcaggttgagaagattgtcaaaaccctgaatgaaggaaatgttccctcttcagatgttgttgaggttgttgtcagtcctccttatgttttcctcccggtggtcaagagccagctgcgccaagagttccaagttgctgctcagaactgctgggtgaagaagggaggtgcattcactggtgaaattagtgctgagat

SEQ ID NO: 69 - DNA, 319 bp, Zea mays
cggacgcgtgggtagaagcacccctctccctctctctctcttcgccgtccgaagctccgcaccccaatctaatcgacacctcaccgagatgggccgcaagttactcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggt

SEQ ID NO: 70 - DNA, 316 bp, Zea mays
atccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgc

SEQ ID NO: 71 - DNA, 276 bp, Zea mays
ctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgcttt

SEQ ID NO: 72 - DNA, 204 bp, Zea mays
gaagatcaaggactggagcaacgtattgttgcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagcta

SEQ ID NO: 73 - DNA, 342 bp, Zea mays
  unsure (1)..(342): unsure at all n locations
ctagaagccccctctccctccctccctctctctctctctcttcgccgtccgaagctccgcacccaatctaatccacacctcagccagatgngccgcaagttcttcgtcggtggcaactggaaatgcaatggaaccacagatcaggtcgagaagattgtcagaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaatggaggtgctttcactggtgaagcagtgctgagatgctcgtca

SEQ ID NO: 74 - DNA, 313 bp, Zea mays
  unsure (1)..(313): unsure at all n locations
aatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggangtgct

SEQ ID NO: 75 - DNA, 277 bp, Zea mays
atttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggttgttgtcagtcctccttatgtgttcctcccggtggtcaagagccagctgcgccaagagttccaagttgctgctcagaactgctgggtgaagaaggg

SEQ ID NO: 76 - DNA, 282 bp, Zea mays
atttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgattgaaggaaatgttccctctacagatgttgttgaggtcgttgtcagtcctccttatgtgttcctcccggtggtcaagagccagctgcgccaagagttccaagttgctgctcagaactgctgggtgaagaagggaggtg

SEQ ID NO: 77 - DNA, 313 bp, Zea mays
acaatttagaagcgaccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggttgttgtcagtcctccttatgtgttcctcccggtggtcaagagccagctgcgccaagagttccaagttgctgctcagaactgctgggtgaagaagggaggtgcattacactggtgaaattagtgctgaga

SEQ ID NO: 78 - DNA, 307 bp, Zea mays
ccaatctagaagctcccctcttcgtccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagg

SEQ ID NO: 79 - DNA, 299 bp, Zea mays
aatccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagg

SEQ ID NO: 80 - DNA, 266 bp, Zea mays
agcgcccctcctcctctcctccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggttgttgtcagtcctccttatgtgttcctcccggtggtcaagagccagctgcgccaagagttccaagttgctgctcagaactgctgggtgaaga

SEQ ID NO: 81 - DNA, 318 bp, Zea mays
cttccttcctctgcaagaagccaaatacaatttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcac

SEQ ID NO: 82 - DNA, 182 bp, Zea mays
actctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtacaggtcgtt

SEQ ID NO: 83 - DNA, 286 bp, Zea mays
ccgtacccaatctaatcgacacccggccgagataagccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcatcactggtgaaattatgctgaatgctcgtcaac

SEQ ID NO: 84 - DNA, 292 bp, Zea mays
ctatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactg

SEQ ID NO: 85 - DNA, 277 bp, Zea mays
aatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaa

SEQ ID NO: 86 - DNA, 298 bp, Zea mays
gctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgttgaggtcgttgtcagccctccttatgtcttccttcctgtggtcaagagccagctgcgccaagagttccatgttgctgctcagaactgctgggtgaagaaggga

SEQ ID NO: 87 - DNA, 272 bp, Zea mays
atttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggttgttgtcagtcctccttatgtgttcctcccggtggtcaagagccagctgcgccaagagttccaagttgctgctcagaactgctgggtgaag

SEQ ID NO: 88 - DNA, 301 bp, Zea mays
  unsure (1)..(301): unsure at all n locations
cacacgcgtccgaactagaagcacccctctacctccctccctctctctctctctcttcgcagtccgaagctccgcacccaatctaatcgacacctcaccgagatgggccgcaagtacttcgtcggtggcaactgganatgcaatggaaccacagatcaggtcgagaagattgtcaaaaccctgaatgaaggacaggttcccccttcagatgttgtcgaggtcgttgtcagcactccttatgtcttccttcctgtggtcaagagccagctgcgccaagagttccatgttgctgctcagaact

SEQ ID NO: 89 - DNA, 307 bp, Zea mays
cggacggtgggcagcgaaatccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctca

SEQ ID NO: 90 - DNA, 310 bp, Zea mays
atccaatctagaagctcccctctccctccctccctctctctctctctcttcgccgtccgaagctccgcacccaatctaatcgacacatcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaaggg

SEQ ID NO: 91 - DNA, 258 bp, Zea mays
caatttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgacgttgttgtcagtcctccttatgtgttcctcccggtggtcaagagccagctgcgccaagagttccaagttgctgctca

SEQ ID NO: 92 - DNA, 294 bp, Zea mays
atctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaaggg

SEQ ID NO: 93 - DNA, 271 bp, Zea mays
ctcccctctccctccctccctctctctctctctcttcgccgaccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctg

SEQ ID NO: 94 - DNA, 274 bp, Zea mays
acggccgagatgggccgcaagttctgcgttggtggcaactggagatgcaatggaaccgcagatcaggttgagaagattgtcaaaaccctgaatgaaggaaatgttccctcttcagatgttgttgaggttgttgtcagtcctccttatgtgttcctcccggtggtcaagagccagctgcgccaagagttccaagttgctgctcagaactgctgggtgaagaagggatgtgcattcactggtgaaattagtgctgagatgctcgtcaaccttggcg

SEQ ID NO: 95 - DNA, 306 bp, Zea mays
ccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaag

SEQ ID NO: 96 - DNA, 280 bp, Zea mays
ctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaaggg

SEQ ID NO: 97 - DNA, 280 bp, Zea mays
tctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgcggctcagaac

SEQ ID NO: 98 - DNA, 276 bp, Zea mays
atccaatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgc

SEQ ID NO: 99 - DNA, 300 bp, Zea mays
  unsure (1)..(300): unsure at all n locations
gcgaaatccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcanaaccctgaatgaaggacaggttcccccttcagatgttgtcgaggtcgttgtcagccctccttatgtcttccttcctgtggtcaagagccagctgcgccaagagttccatgttgctgctcagaactg

SEQ ID NO: 100 - DNA, 316 bp, Zea mays
gatcaatgtcagccctgaggtctctgaatctacaaggatcatctatggaggttcagtaactgctgcgaactgcaaagagctggcagcacagcctgatgtcgatggtttccttgtgggcggtgcttctttgaagcccgagttcatcgacatcatcaacgccgccgccgtgtgaagtccgctgaagatgttccaacccttcaccctgttgcggtgatgtgctgaagacagatcagactatttttttgtttaaccgtgcagtgctatgtaagctactaactttgcgctggtgcggatgctgatttccctccccctagct

SEQ ID NO: 101 - DNA, 325 bp, Zea mays
agatcaatgtcagccctgaggtctctgaatctacaaggatcatttatggaggttcagtaactgctgcgaactgcaaagagctggcagcacagcctgatgtcgatggtttccttgtgggcggtgcttctttgaagcccgagttcatcgacatcatcaacgccgccgccgtgtgaaatccgcttaagatgttccaacccttcaccctgttgcggtgatgtgctgaagacagatcagactatttttttgtttaaccgtgccgtgctatgtaagctactaactttgcgctggtgcggatgctgatttccctcccccctagctttttgtg

SEQ ID NO: 102 - DNA, 273 bp, Zea mays
caatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgcc

SEQ ID NO: 103 - DNA, 281 bp, Zea mays
gcgatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaact

SEQ ID NO: 104 - DNA, 297 bp, Zea mays
ccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgcctaaaccctgaatgaaggacaggttcccccttcagatgttgttgaggtcgttgtcagccctccttatgtcttccttcctgtggtcaagagccagctgcgccaagagttccatgttctgctcagaactgctggg

SEQ ID NO: 105 - DNA, 278 bp, Zea mays
atttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggttgttgtcagtcctccttatgtgttcctcccggtggtcaagagctagctgcgccaagagttccagttgctgctcagaactgctgggtgagaagggagt

SEQ ID NO: 106 - DNA, 216 bp, Zea mays
gcgaaatccaatctagaagcacacctctccctctctctctcttcgccgtccgaagctccgcaccccaatctaatcgacacctcaccgagatgggccgcaagttcttcgtcggtggcaactggaaatgcaatggaaccacagatcaggtcgataagattgtcaaaaccctgaatgaaggacaggttcccccttcagatgttgtggaggtcgttgtca

SEQ ID NO: 107 - DNA, 188 bp, Zea mays
gagaagtagtgtaggctatgaaccagtttgggctattggaactggtaaagttgccaccccagctcaggctcaggaagtgcacgcctccctgagggattggctaaagaccaacgtcagccctgaggttgctgaatctactaggatcatttacggaggctctgtaactgccgcgaactgcaaagagctag

SEQ ID NO: 108 - DNA, 204 bp, Zea mays
cggctcgagtctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgt

SEQ ID NO: 109 - DNA, 278 bp, Zea mays
atccaatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgcgg

SEQ ID NO: 110 - DNA, 265 bp, Zea mays
atctagaagccccctctccctcctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgtt

SEQ ID NO: 111 - DNA, 270 bp, Zea mays
ctaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagag

SEQ ID NO: 112 - DNA, 259 bp, Zea mays
ccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagag

SEQ ID NO: 113 - DNA, 294 bp, Zea mays
atccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaag

SEQ ID NO: 114 - DNA, 237 bp, Zea mays
atacaatttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggttgttgtcagtcctccttatgtgttcctcccggtggtcaagagccagctgcg

SEQ ID NO: 115 - DNA, 203 bp, Zea mays
ccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcg

SEQ ID NO: 116 - DNA, 255 bp, Zea mays
aatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgc

SEQ ID NO: 117 - DNA, 209 bp, Zea mays
tcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagc

SEQ ID NO: 118 - DNA, 216 bp, Zea mays
ctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagcc

SEQ ID NO: 119 - DNA, 160 bp, Zea mays
acaaaagcaattgctgagaagatcaaggactggagcaacgtattgttgcctatgaaccagtttgggctattggaactggtaaagttgccaccccagctcaggctcaggaagtgcacgcctccctgagggattggctaaagaccaatgccagccctgaggt

SEQ ID NO: 120 - DNA, 296 bp, Zea mays
gtatttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcactggtg

SEQ ID NO: 121 - DNA, 238 bp, Zea mays
caatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtca

SEQ ID NO: 122 - DNA, 303 bp, Zea mays
catcaaatgaatttgttggagacaagactgcgtatgccctgtctcagggactaaaggtcattgcatgtgttggtgagacccttgagcagagtgaggctgggtctaccatggatgttgttgctgcacaaacaaaagcaattgctgagaagatcaaggactggagcaacgtagttgttgcctatgaaccagtttgggctattggaactggtaaagttgccaccccagctcagctcaggaagtgcacgcctacctgagggattggctaaagaccaatgccagccctgaggatgctgaatctactag

SEQ ID NO: 123 - DNA, 242 bp, Zea mays
caatttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgacggaaatgttccctcttcagatgttgttgaggtcgttgtcagtcctccttatgtgttcctcccggtgggcaagagccagtgcgccaagagtt

SEQ ID NO: 124 - DNA, 327 bp, Zea mays
cacaaacctcaccccacctatattatcccgtgccccttgtctttcttcctccacaagcagcgaaatccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctg

SEQ ID NO: 125 - DNA, 297 bp, Zea mays
catccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtattccttcctgtggtcaagagccagctgcgccaagagttccatgttgctgctcagaactgctgggtgaagaa

SEQ ID NO: 126 - DNA, 253 bp, Zea mays
ctaaagaccaatgccatccctgaggctgctgaatctgctaggatcatctacggaggctctgtaactgctgcgaactgcaaagagctagcagtacagcctgacgtcgatggttgtcttgccgactgagcttctttgaagcctgagttcatcgacatcatcaacgcggccaccgtgaagtccgcttaagatgctacgctgaagactgaacatacttctttttgctcaactgtgctatgtaagctagtagcttttg

SEQ ID NO: 127 - DNA, 171 bp, Zea mays
  unsure (1)..(171): unsure at all n locations
gaagctcncctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgattaa

SEQ ID NO: 128 - DNA, 246 bp, Zea mays
gaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctcctaatgtcttccttcctgtggtcaagag

SEQ ID NO: 129 - DNA, 240 bp, Zea mays
cctccacaagcagcgaaatccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatg

SEQ ID NO: 130 - DNA, 212 bp, Zea mays
atccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgag

SEQ ID NO: 131 - DNA, 151 bp, Zea mays
  unsure (1)..(151): unsure at all n locations
cagcagctgcgccaagagttccatgttgctgctcagaactgctgngtgaagaagggaggtgctttcactggtgaagtcagtgctgagatgctcgtcaaccttggtgttccctgggtcattcttggacactctgaaaggagagctctgctgg

SEQ ID NO: 132 - DNA, 279 bp, Zea mays
  unsure (1)..(279): unsure at all n locations
ccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattggcaaaaccctgaacgaaggacagggtcccccgtcagaagtcgtcgagggcgntggcagcccnccctaaggcnttcctcccgnggacaagagccagcatcgccaagagttccatgtt

SEQ ID NO: 133 - DNA, 128 bp, Zea mays
aatctagaagcacccctctccctctctctctcttcgccgtccgaagctccgcaccccaatctaatcgacacctcaccgagatgggccgcaagttcttcgtcggtggcaactggaaatgcaatggaacc

SEQ ID NO: 134 - DNA, 150 bp, Zea mays
cagcgaaatccaatctagaagcacccctctccctctctctctcttcgccgtccgaagctccgcacccaatctaatcgacacctcaccgagatgggccgcaagttcttcgtcggtggcaactggaaatgcaatggaaccacagatcaggtc

SEQ ID NO: 135 - DNA, 323 bp, Zea mays
ggaactcggggaggtgagcagaggtggtggtgagtccgcctttcgtttttctgcagcaggtcaaggggctgctgcggctggacttcgccgtcgcagcgcagaactgctgggtgcgcaagggcggcgccttcaccggcgagatcagtgctgagatgctggtaaacctgcaggtgcctgggtcattttgggacattctgagcgcagagctctgttgggtgaatccagtgattttgttgctgataaagttgcatatgcactcactcaaggtctcaaggtaattgcttgcattggtgagacccttgagcagagagaggcaggaacaa

SEQ ID NO: 136 - DNA, 214 bp, Zea mays
gtggtgagtccgcctttcgtttttctgcagcaggtcaaggggctgctgcggctggacttcgccgtcgcagcgcagaactgctgggtgcgcaagggcggcgccttcaccggcgagatcagtgctgagatgctggtaaacctgcaggtgccctgggtcattttgggacattctgagcgcagagctctgttgggtgaatccagtgattttgttgctg

SEQ ID NO: 137 - DNA, 267 bp, Zea mays
cacgaattcaccaaccaaactccactgtctccaactctccatcgcgtctgctacgcctctcctgcaggacgaccaatggcttccaggaagttcttcgtgggtggcaactggaaatgcaacggtactggcgaggacgtgaagaagatcgtcaccgtgctcaacgaagccgaggtgccctctgaagacgtcgtcgaggtggtggtgagtccgccgttcgtttttctgcagcaggtcaaggggctgctgcggctggacttcgccgtcgca

SEQ ID NO: 138 - DNA, 191 bp, Zea mays
ggaactcggggaggtgagcagaggtggtggtgagtccgcctttcgtttttctgcagcaggtcaaggggctgctgcggctggacttcgccgtcgcagcgcagaactgctgggtgcgcaagggcggcgccttcaccggcgagatcagtgctgagatgctggtaaacctgcaggtgccctgagtcattttggga

SEQ ID NO: 139 - DNA, 322 bp, Zea mays
  unsure (1)..(322): unsure at all n locations
tcacaacanactccactgtctccaactctccatcgcgtctgctacgcctctcctgcatgacgaccaatggcttccangaagttcttcgtgggtggcaactgganatgcaacggtactggcgaggacgtgaagaagatcgtcaccgtgctcaacgaagccgaggtgccctctgaagacgtcgtcgangtggtggtgagtccgccgttcgtttttctgcagcanngtcaagggctgctgcggctagacttcgccgtcgcagcgcagaactgctgngtgcgcaagggcngcgccttcaccggcgagatcagtgctgagatgctgg

SEQ ID NO: 140 - DNA, 240 bp, Zea mays
caccaaccaaactccactgtctccaactctccatcgcgtctgctacgcctctcctgcaggacgaccaatggcttccaggaagttcttcgtgggtggcaactggaaatgcaacggtactggcgaggacgtgaagaagatcgtcaccgtgctcaaccaagccgaggtgccctctgaagacgtcgtcgaggtggtggtgagtccgcctttcgtttttctgcagcaggtcaaggggctgctgcg

SEQ ID NO: 141 - DNA, 284 bp, Zea mays
accaaactccactgtctccaactctccatcgcgtctgctacgcctctcctgcaggacgaccaatggcttccaggaagttcctcgtgggtggcaactggaaatgcaacggtactggcgaggacgtgaagaagatcgtcaccgtgctcaaccaagccgaggtgccctctgaagacgtcgtcgaggtggtggtgagtccgcctttcgtttttctgcagcaggtcaaagggctgctgcggctggacttcgccgtcgcagcgcagaactgctgggtgcgcaaggaggcg

SEQ ID NO: 142 - DNA, 166 bp, Zea mays
cacgaattcaccaaccaaactccactgtctccaactctccatcgcgtctgctacgcctgtcctgcaggacgaccaatggcttccaggaagttcttcgtgggtggcaactggaaatgcaacggtactggcgaggacgtgaagaagatcgtcaccgtgctcaaccaag

SEQ ID NO: 143 - DNA, 322 bp, Zea mays
gcctcctctcccgttcccccaccaaccgcagcagcgagagcgagactgagaatggccgcggcgccgtcgtccctcgtgtcctcccatctctctcgcctcgccgacctccgccgcgcggcgcgccggccactcccaccgtcccacagcagcttcgcgtcggctgctcgcaccgccgcgcccagcgcgtcgtcgccatggctggatccggcaagttcttcgtcggaggcaactggaagtgcaacgtaacaaaggactccgttagcaagcttgtctctgaactgaatgctgctaccctcgaaactgatgtagatgttgtggtggc

SEQ ID NO: 144 - DNA, 303 bp, Zea mays
cctcgccctcgccgcctcctctcccgttcccccaccaaccgcagcagcgagagcgagactgagaatggccgcggcgccgtcgtccctcgtgtcctcccatctctctcgcctcgccgacctccgccgcgcgcggcgccggccactcccaccgtcccacagcagcttcgcgtcggctgctcgctccgccgcgcccagcgcgtcgtcgccatggctggatccggcaagttcttcgtcggaggcaactggaagtgcaacggaacaaaggactccgttagcaagcttgtctctgaactgaatgctgct

SEQ ID NO: 145 - DNA, 270 bp, Zea mays
ctcgccgcctgctcctctccagttctcccccaccaaccgcagcagcgagagcgagactgagaatggccgcggcgccgtcgtccctcgtgtcctcccatctctcccgcctcgccgacctccgccgcgctgcggcgccggccactcccaccgtcccacagcagcttcgcgtcggcttctcgcgccgccgcgcccagcgcgtcgtcgccatggctggatccggcaagttcttcgtcggaggcaactggaagtgcaacggaacaaaggactccg

SEQ ID NO: 146 - DNA, 301 bp, Zea mays
ccgacgcgtgggcgccgcctgctcctctccagttctcccccaccaaccgcagcagcgagacgagactgagaatggccgcggcgccgtcgtccctcgccacctcccatctctcccgcctcgccgacctccgccgcgcggcgcgccggccactcccaccgtcccacagcagcttcgcgtcggcttctcgcgccgccgcgcccagcgcgtcgtcgccatggctggatccggcaagttcttcgtcggaggcaactggaagtgcaacgtaacaaaggactccgttagcaagcttgtctctgaactg

SEQ ID NO: 147 - DNA, 282 bp, Zea mays
  unsure (1)..(282): unsure at all n locations
cccacgcgtccgcgccgcctgctcctctccagttctcccccaccaaccgcagcagcgagagcgagactgagaatggccgcggcgccgtcgtccctcgtgtcctcccatctctcccgcctcgccgacctccgccgcgcggcggcgccggnccactcccaccgtcccacagcagcttcgcgtcggcttctcgcgccgccgcgcccagcgcgtcgtcgccatggctggatccggcaagttcttcgtcggaggcaactggaagtgcaacgcaacaaaggactccgt

SEQ ID NO: 148 - DNA, 273 bp, Zea mays
tcgccctcgccgcctgctcctctccagttctcccccaccaaccgcagcagcgagagcgagactgagaatggccgcggcgccgtcgtccctcgtgtcctcccatctctcccgcctcgccgacctccgccgcgcggcgcgccggccactcccaccgtcccacagcagcttcgcgtcggcttctcgcgccggcgcgcccagcgggtcgtcgccatggctggatccggcaagttcttcgtcggaggcaactggaagtgcaacgcaacaaaggactcc

SEQ ID NO: 149 - DNA, 275 bp, Zea mays
acgaactgctaccccctcgcctcgccctcgccgcctgctcctctccagttctcccccaccaaccgcagcagcgagagcgagactgagaatggccgcggcgccgtcgtccctcgtgtcctcccatctctcccgcctcgccgacctccgccgcgcggcggcgccgagccactcccaccgtcccacagcagcttcgcgtcggcttctcgcgccgccgcgcccagcgcgtcgtcgccatggctggatccggcaagttcttcgtcggaggcaactggaag

SEQ ID NO: 150 - DNA, 300 bp, Zea mays
tggacgaactgctaccccctcgcctcgccctcgccgcctgctcctctccagttctcccccaccaaccgcagcagcgagagcgagactgagaatggccgcggcgccgtcgtccctcgtgtcctcccatctctcccgcctcgccgacctccgccgcgcggcggcgccggaccactcccacagtcccacagcagcttcgcgtcggcttctcgcgccgccgcgcccagcgcgtcgtcgccatggctggatccggcaagttcttcgtcggaggcaactggaagtgcgtaagtgcatgttctgctt

SEQ ID NO: 151 - DNA, 255 bp, Zea mays
acgaactgctaccccctcgcctcgccctcgccgcctgctcctctccagttctcccccaccaaccgcagcagcgagagcgaggactgagaatggccgcggcgccgtcgtccctcgtgtcctcccatctctcccgcctcgccgacctccgccgcgcggcggcgccggccactcccaccgtcccacagcagcttcgcgtcggcttctcgcgccgccgcgcccagcggtcgtcgccatggctggatccggcaagttctt

SEQ ID NO: 152 - DNA, 283 bp, Zea mays
cgaaccttggcgtctgccctaccaaccgcagcagcgacactagaatggccgcggcgccgtcatccctcgcgtcctcccacctctccccaatcgcggcggtgtccactcccgccgtcccacatcagcttcgcatcggctgctcccgccgccgcgcccagcgcatcgttgccatggctggatccggcaagttcttcgtcggaggcaactggaagtgcaatggaacaaaggactccattagcaaacttgtctctgaattgaatgctgctacccttgaaactgatgt

SEQ ID NO: 153 - DNA, 282 bp, Zea mays
ccgaaccttggcgtctgccctaccaaccgcagcagcgacactagaatggccgcggcgccgtcatccctcgcgtcctcccacctctccccaatcgcggcggtgtccactcccgccgtcccacatcagcttcgcaccggctgctcccgccgccgcgcccagcgcatcgttgccatggctggatccggcaagttcttcgtcggaggcaactggaagtgcaatggaacaaaggactccattagcaaacttgtctctgaattgaatgctgctacgcctgaaactgat

SEQ ID NO: 154 - DNA, 235 bp, Zea mays
cggctcgagcaaccgcagcagcgacactagaatggccgcggcgccgtcatccctcgcgtcctcccagctctccccaatcgtcggggtgtccactcccgccgtcccacatcagcttcgcatcggctgctcccgccgccgcgcccggcgcatcgttgccatggctggatccggcaagttcttcgtcggagggccctggacgtgcaatggaacaaaggactccattaacaaacttgtc

SEQ ID NO: 155 - DNA, 273 bp, Zea mays
gcttctagtccctcgcctaccccgcccccgaacctggcgtctgccctaccaaccgcagcagcgacactagaatggccgcggcgccgtcatccctcgcgtcctcccacctctccccaatcgcggcggtgtccactcccgccgtcccacatcagcttcgcatcgcttgctcccgccgccgcgccgggcgcatcgttgccatggctggatccggcaagttcttcgtcggaggcaactggaagtgcaatggaacaaaggctccattagcaaacttgt

SEQ ID NO: 156 - DNA, 305 bp, Zea mays
cagagagaggcaggaacaacaatggatgttgttgctgcacaaacaaaggctattgctgaaaaaatatcagattggacaaatattgtgttggcatatgaaccagtttgggctattggtaccggcaaagttgcaactcctgctcaggctcaggaggttcatgatggtctgagaaagtggctccactccaatgttagccctgcagttgctgaattgacaaggataatttatggagggtctgtaaatggagctaactgcaaagaacttgcagctcaaccagatgttgatggattccttgttggtggagc

SEQ ID NO: 157 - DNA, 290 bp, Zea mays
cattggacaaatattgtgttggcatatgaaccagtttgggctattggtaccggcaaagttgcaactcctgctcaggctcaggaggttcatgatggtctgagaaagtggctccactccaatgttagccctgcagttgctgaattgacaaggataatttatggagggtctgtaaatggagctaactgcaaagaacttgcagctcaaccagatgttgatggattccttgttggtggagcctcattgaagcctgaattcgtggacatcatcaagtctgccactgtcaagtcttc

SEQ ID NO: 158 - DNA, 309 bp, Zea mays
aaacttttgaagtatgttttgagcagatgaaggcttttgcagatagtatttcaaactgggccgatgttgtgattgcatatgagcctgtttgggctattggaaccggaaaagttgctactcctgagcaagcccaggaagttcatgctgctgtacgcgattggttgacgaccaacatatcacctgatgttgcctctagcacccgaataatctatggaggttctgtgaatgcagccaactgtgcagagctagcaaagaaagaggatatcgatggttttcttgttggtggtgcctccttgaaggccccggact

SEQ ID NO: 159 - DNA, 280 bp, Zea mays
gtgattgcatatgagcctgtttgggctattggaaccggaaaagttgctactcctgagcaagcccaggaagttcatgctgctgtacgcgattggttgacgaccaacatatcacctgatgttgcctctagcacccgaataatctatggaggttctgtgaatgcagccaactgtgcagagctagcaaagaaagaggatatcgatggttttcttgttggtggtgcctccttgaaggccccggacttcgccaccattatcaactcagtgaccgccaagaaagttg

SEQ ID NO: 160 - DNA, 295 bp, Zea mays
  unsure (1)..(295): unsure at all n locations
cagttaaggttatctgccgtgcatagcgagagcgttctggaagagtagggatgcagggataacttttgaagtatgttttgagcagatgaaggcttgtgcagatagtatttcaaactgggccgatgttgtgattgcatatgagcctgtttgggctattggaaccggataagttgctactcctgagcaagcccaggaagttcatgctgctgtacgcgattggttgacgaccaacatatcacctgatgttgcctctagcaattttntaatctatggaggttctgtgaatgcagccaac

SEQ ID NO: 161 - DNA, 242 bp, Zea mays
agagagggaagcaggcaaaacttttgatgtatgttttaggcagatgaaggcttttgcagatagtatttcaaactgggcagatgttgtaattgcatacgagcctgtttgggcgattggaaccggaaaagttgctactcctgagcaagcccaggaagttcatgctgctgtacgcaattggctgaagaccaacatatcacccgatgttgcctctagcactcgaataatctatggaggttctgtga

SEQ ID NO: 162 - DNA, 237 bp, Zea mays
cggaaaagttgctactcctgagcaagcccaggaagttcatgctgctgtacgcgattggttgacgaccaacatatcacctgatgttgcctctagcacccgaataatctatggaggttctgtgaatgcagccaactgtgcagagctagcaaagaaagaggatatcgatggttttcttgttggtggtgcctccttgaaggccccggacttcgccaccattatcaactcagtgaccgccaa

SEQ ID NO: 163 - DNA, 314 bp, Zea mays
cccacgcgtccggcctcgttgaaggccccggacttcgccaccattatcaactcagtgaccgccaagaaagttgcagcctgatggaccaccctgtgagaaataagaggccatcagcgtgtcgcctcatctgccacgccttaaagcctgtataggaggtgatccgtgtgatggtgtgcccgtcacctcctgtttttgctgatttgcagcacggggacagaaaataatgttttgctctcgtggacctgcactgcacgtgacgaggagagttcagttgtcgtgagcgatgtacgttggggatattgtgatgtggtcct

SEQ ID NO: 164 - DNA, 167 bp, Zea mays
  unsure (1)..(167): unsure at all n locations
cggaggttctgtgaatgcagccaactgtgcagagctagcaaagaaagaggatatcgatggttttgttgttggtggtgcctccttgaaggccccggacttcgccaccattatcaactcagtgaccgccaagaaagttgcagcctcgtgngancacctgtgaagaaata

SEQ ID NO: 165 - DNA, 368 bp, Zea mays
ttcggctcgaggaattgaatgctgtacccttgaaactgatgtagatgttgtggtggcacatccattcatctatattgatcaggttaagaattcactaactggtcgcattgaggtttctgctcagaatgtgtggattggaaaaggaggagcctacaccggagagatcagtgcagaacaactggtggacatcggctgtcaatgggttattcttggacactctgagcgtagacatattattggtgaaaatgatgagtttattggaaagaaggctgcatatgcattgagcccaaatgttaaggttattgcctgcataggagagctgctggaagagagggaagcaggcaatacttttgatgtatgtctaggca

SEQ ID NO: 166 - DNA, 304 bp, Zea mays
cctcgaaactgatgtagatgttgtggtggctcctccattcatctatatcgatcaggtcaagaattcactaacgggtcgcattgaggtttctgctcagaatgtgtggattggaaaaggaggagcctacaccggagagatcagtgcagaacaactggtggacatcggttgtcaatgggttattcttggacactcagagcgtagacatattattggtgaaaatgacgagtttattgggaagaaggctgcatatgcattgagccaaaatgttaaggttattgcctgcataggagagcttctggaagag

SEQ ID NO: 167 - DNA, 261 bp, Zea mays
gtggtggcacctccatttatctatattgatcaggttaagaattcactaactggtcgcattgaggtttctgctcagaatgtgtggattggaaaaggaggagcctacaccggagagatcagtgccgaacaactggtggacatcggctgtcaatgggttattcttggacactctgagcgtagacatattattggtgaaaatgatgagtttattggaaagaaggctgcatatgcattgagccaaaatgttaagggtattgcctgc

SEQ ID NO: 168 - DNA, 225 bp, Zea mays
tctatatcgatcaggtcaagaattcactaacgggtcgcattgaggtttctgctcagaatgtgtggattggaaaaggaggagcctacaccggagagatcagtgcagaacaactggtggacatcggttgtcaatgggttattcttggacactcagagcgtagacatattattggtgaaaatgacgagtttattgggaagaaggctgcatatgcattgagccaaaatg

SEQ ID NO: 169 - DNA, 328 bp, Zea mays
atacaatttagaagcgcccctcctcctctcccccatccgtacccaatctaatcgacacccggccgagatgggccgcaagttcttcgttggtggcaactggaaatgcctggaagagcccgcgttcttcttccaatgcgcctgtgcttccaggctccagcccagagcaaatcgtaaaagcccttcataagtttcgtgatgcatgttgtctgtaggagcagaggagttcgatatccaacttttggagacccattctcgtttgctgcacgaattaaccttacgtttcttgtcatggagctcggggcttgctcaatctgagcataggttggag

SEQ ID NO: 170 - DNA, 228 bp, Zea mays
  unsure (1)..(228): unsure at all n locations
gaagggaggtgcncccactgaatncatnaccatttgagatnctngacaacctnctgggggtagggttcanggctggncgccctgaaaggagaacnntaataagaaaataacatgaattcgggatccgcagagtcnncgtntgcggcggcggngggactaaangtcattgcatgtgttgccgagacncttgaacacaacnagntngtggacnncatnctncnncncggg

SEQ ID NO: 171 - DNA, 339 bp, Zea mays
ctagagttttgcagcaacctagcactaaggctcctgctaaaaagggaaaacagcaagcattgacaagtgctgaagaaccagatgagcctcctctgtgaagaggagcctacaccggactgatcagtgcaaaacaactggtggacatcatctgtcaatggatgattcttggacactctgagcgtagacatattattggtgaaaatgatgagtttattggaaagaaggctgcatatgcatagagccaaaatgttaagggcattgcctgcataggagagctgcttgaagagagtgaagcatgcaaaactcttaatgtatgttgaatgcagatgaaggcttttg

SEQ ID NO: 172 - DNA, 348 bp, Zea mays
aacacgcgtccggcctccttgaaggccccggacttcgccaccattatcaactcagtgaccgccaagaaagttgcagcctgatggaccaccctgtgaagaaataagaggccatcaccgtgtcgcctcatctgccacgccttaaagcctgtaggaggcgtcacctcctgtttttgctgatttgcagcacggggacagaaaataatgttttgctctcgtggatctgcacgtgacgaggagagttcagttgtcgtgagcgatgtacgttgggaatattgttatgtggtccttttctaaagaaaaaaaatgttgacagtcaaggaaaaataataaaaaaaggcggccgctcta

SEQ ID NO: 173 - DNA, 373 bp, Zea mays
gcgcgcctcggcttcagcgccatggcgccctccaggaagttcttcgttgggggagactgggagaagaacgggcggaagcacagtctgggggagctcatcggcactctgaacgcggtcaaggtgccggccgacaccgatgtggaacgtgctcagcatactgcctatatcgacttagtccggcagaagctagatcccaagaacgctgaggctgcgcagaactgctacaaagtgactaatgacgcttgaactgatgagatcagccctggcatgatcaaacactgcggagccacacgggcggtactggggcactcagagagaacgcatgtctttggggagtcagatgagctgattgggcacaaagtgcgccatgctc

SEQ ID NO: 174 - DNA, 442 bp, Zea mays
ggtggagcttctttgaagcctgagttcatcgacatcatcaacgcggccaccgtgaagggcgctgaagatgttacgctgaagacgaacatactttttttttgctcaactgtgctatgtaagctagtagcttttgcgcaggagcagagactgttttgcctgcccccaacttttagcttgagcttgctaataatgtttacctctggacgtatcaataatggtgcttatgtaccccttttttgtgccgaattacggtggatccgtcatctgaaccatgggtttggtgtatgtaattgcgtcacccgatgcctaaggtgagactgaagtttttggacatttgggacaaggtagccttgtgccccacattggtcgaatgctgccaaaactgtaccggtcatctgtgctccgtacggattagcctgatctgcgaatgcaacttgtcagc

SEQ ID NO: 175 - DNA, 433 bp, Zea mays
cccacgcgtccgggatcatttacggaggctctgtaactgccgcgaactgcaaagagctggcagcacagcctgatgtcgatgggtttcttgtcggtggagcttctttgaagcctgagttcatcgacatcatcaacgcggccaccgtgaagtccgcttaagatgttacgctgaagacgaacatactttttttttgctcaactgtgctatgtaagctagtagcttttgcgcaggagcagagactgttttgcctgcccccaacttttagcttgagcttgctaataatgtttacctctggacgtatcaataatggtgcttatgtaccccttttttgtgccgaattacggtggatccgtcatctgaaccatgggtttggtgtatgtaattgcgtcacccgatgcctatggtgagactgaagtttttggacatttgggac

SEQ ID NO: 176 - DNA, 427 bp, Zea mays
cgcaccccaatctaatcgacacctcgccgtgatgggccgcaagttcttcgtcggtggcagctggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgcggctcagaactgctgggttaagaagggaggtgctttcaccggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacactt

SEQ ID NO: 177 - DNA, 457 bp, Zea mays
aaggttgcgtatgccctgtctcagggactaaaggtcattgcatgtgttggtgagacagttgggcagagggaggctgggtctaccatggaggttgttgctgcacaaacaaaagcaattgctgagaagatcaaggactggagcaacgtagttgttgcctatgaaccagtttgggctattggaactggtaaagttgccaccccagctcaggctcaggaagtgcacgccttcctgagggattggctaaagaccaacgtcagccctgaggttgctgaatctactaggatcatttacggaggctctgtaactgccgcgaactgcaaagagctagcagcacagcctgatgtcgatgggtttcttgtcggtggagcttctttgaagcctgagttcatcgacattatcaacgcggtcaccgtgaagtccgcttaagatgttacgctgaagacgaacatactttttt

SEQ ID NO: 178 - DNA, 471 bp, Zea mays
  unsure (1)..(471): unsure at all n locations
agggtttntcaacgtcacgtcgcacggacagtacagactacacggtcgagcacgcgtccgaccacacgtccgcccacgcgtccggctgcgccaaaatttcaatgttgcggctcaaaactgctggttaaacaagggaggtcctttcactggtgaactcagtgctgagatgctcgtcaaccttggtgttccctgcgtcattcttggacactctgaaacgagagctctgctgggagaatcaaatgaatttgttggagacaaggttgcgtatgccctgtctcagggactaaaggtcattgcatgtgttggtgagacccttgagcagaaggaggctgggtctnacatggatgttgttgctgcacaaacaaaagcaattgctgagaagatcaaggactggagcaacgtacttgttgcctatgaaccagtttgggctattggaactggtacagttgccacctcagctcaggctcagga

SEQ ID NO: 179 - DNA, 402 bp, Zea mays
cccacgcgtccgcccacgcgtccggacaaggttgcgtatgccctgtctcagggactaaaggtcattgcatgtgttggtgagacccttgagcagagggaggctgggtctaccatggatgttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacagcctgatgtcgatggttttcttgtcggtggagcttctttg

SEQ ID NO: 180 - DNA, 450 bp, Zea mays
atttagaagcgcccctcctcctctcccccttccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgcttagaactgctgggtgaataagggaggtgcattcactggtgaaattagtgctgaaatgctcgtcaaccttggcgttccctgggtcattcttggacactctgaaaggagagctctgctgggagaatcaaatgagtttgttggagacaaggttggctttgctctgtctaagggactaaaggtcattgcatgtgttggtg

SEQ ID NO: 181 - DNA, 503 bp, Zea mays
cggcgctcgaggggctgactgttcatttcgcctgtcggtgcaagtccgaaattcgccgggccacccacgcaaccgaaccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaggagagctctgctgggagaatcaaatgaatttgttgga

SEQ ID NO: 182 - DNA, 387 bp, Zea mays
cccacgcgtccgcgcccctcctcctctccttcatccgtacccaatctaatctacacccgggcgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcactggtgaaattagtgctgaaatgctcgtcaaccttggcgttccctgtgtcattcttggacactctgaaaggagagctctgctgggagaatcaaatg

SEQ ID NO: 183 - DNA, 404 bp, Zea mays
  unsure (1)..(404): unsure at all n locations
acttgagcagagggaggctgggtctaccatggaggttgttgctgcacaaacaaaagcagttgctgagaagatcaaggactggagcaacgtagttgttgcctatgaaccagtttgggctattggaactggtaaagttgccaccccagctcaggctcaggaagtgcacgcctccctgagggattggctaaagaccaacgtcagccctgaggttgctgaatctactaggatcatttacggaggctctgtaactgccgcgaactgcaaagagctagcagcacagcctgatgtcgatgggtttcttgtcggtggagcttctttgaagcctgagttcatcgacatcatcaacgcggccaccgtgaagtccgcttaagatgttacgctgaagacgaacatactnttttttt

SEQ ID NO: 184 - DNA, 413 bp, Zea mays
aatccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaggaaagctctgctgggaaaatcaaatgaatttg

SEQ ID NO: 185 - DNA, 423 bp, Zea mays
  unsure (1)..(423): unsure at all n locations
agggggntnnnaacagggccccagtcccncgcacgctccaccggaanggaagggncgacccgagcgagcggntgctcagaactgctgggtgaagaagggttgtgcattcactggtgaaattagtgctgaaatgctggtcaaccttggcgttccctgggtcattcttggacactctgaaaggagagctctgctgggagaatcaaatgagtttgttggagacaaggttgcttttgctctgtctcagggactaaaggtcattgcatgtgttggtgagacccttgaggagagggaggctggttcaaccatggatgttgttgctgcacaaacaaaagcaattgctgagaagatcaaggactggagcaacgttgttcttgcctatgaaccagtctgggctattggaactggcaaagtcgccaccccagc

SEQ ID NO: 186 - DNA, 423 bp, Zea mays
  unsure (1)..(423): unsure at all n locations
aagctccgacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaggagagctctgctaggagaatcanatgaatctgttggagacaaggttgcgtatgccctgtcttaaggactaaaggtcattgcatgttgtggtg

SEQ ID NO: 187 - DNA, 379 bp, Zea mays
gggaggtgcattcactggtgaaattagtgctgagatgctcgtcaaccttggcgttccctgggtcattcttggacactctgaaaggagagctctgctgggagaatcaaatgagtttgttggagacaaggttgcttttgctctgtctcagggactaaaggtcattgcatgtgttggtgagacccttgaggagagggaggctggttcaaccatggatgttgttgctgcacaaacaaaagcaattgctgagaagatcaaggactggagcaacgttgttcttgcctatgaaccagtctgggctattggaactggcaaagtcgccaccccagctcaggctcaggaagtgcacgccttcctgagggattgggtaaagatcaatgtc

SEQ ID NO: 188 - DNA, 349 bp, Zea mays
  unsure (1)..(349): unsure at all n locations
cggacgcgtgggctgaaaggagagctctgctgggagaatcaaatgaatttgttggagacaaggttgcgtatgccctgtctcagggactaaaggtcattgcatgtgttggtgagacacttgagcagagggaggctgggtctaccatggaggttgttgctgcacaaacaaaagcaattgctgagaagatcaaggactggagcaacgtagttgttgcctatgaaccagtttgggctattggaactggtaaagttgccaccccagctcaggctcaggaagtgcacgcctncctgagggattggctaaagaccaacgtcagccctgaggttgctgaatctactaggatcattta

SEQ ID NO: 189 - DNA, 314 bp, Zea mays
caggtcgagaagattgtcaaaaccctgaatgaaggacaggttcccccttcagatgttgtggaggtcgttgtcagccctccttatgtcttccttcctgtggtcaagagccagctgcgccaagagttccatgttgcggctcagaactgctgggttaagaagggaggtgctttcaccggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaa

SEQ ID NO: 190 - DNA, 360 bp, Zea mays
gcctctgttggccgttcgaatctccgcacccaatttaatcgacacctcaccgagatgggccgcagagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaagagagctct

SEQ ID NO: 191 - DNA, 338 bp, Zea mays
gccaaatacaatttagaagcgcccctcctcctctcccccatccgtacccaatcgaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcactggtgaaattagtgctgaaatgctcgtcaaccttggcgt

SEQ ID NO: 192 - DNA, 430 bp, Zea mays
agcatcgtaggcggccatcatcaaactacaggctcatggctaggactcgcgggcagatacacgcctcagaattgattcgtaggagacaatgttgcgtatgccctgtctcatggactaacggtcattgcatgtgttggtgatacccttgatcatagggatgctgagtctaccatggatgttgttgctgcacatccagaagcaattgctgataacatcaaggactggatcaacgtaattgttgcctatgaaccactttgggctattggaactggtaaagttgccaccccagctcaggctcaggaagtgcacgcctccctgaaggattggctaaagaccaatgccatccctgaggttgctgaatctactaggatcatctacggaggctctgtaactgctgcgaactgcagatagctagcagcacagcctgatg

SEQ ID NO: 193 - DNA, 408 bp, Zea mays
gcgatccaatctagactctcccctcttcctccctccctctctctatctctcttcggggtccgaatctacggacccaagcgaatcgacacctcaccgacatgggccgcacgctcttcatccgtggcaactggaaatgcaatggaaccacagatcatgtcgcgaacatagtcaaaaccctgaatgaacgacaggttcccccttcagatcttgaccaggtcgttgccagccctacttatgtcttccttcctgtgctcaagagccagctgtgccaagagttccatgatgctgctcataactgctgggtgaagaaaggacgtgctttcactggtgaactcagatctgagatgctcctcaaccttggtgatccctgagtcattcttggacactctgaaacgagaactctgcttg

SEQ ID NO: 194 - DNA, 267 bp, Zea mays
tcggccacgccgttcgccacgcgttcgcttggacactcttaaaggagagctcttcttggagaatcaaatgaatttgttggagacaaagttgcgtatgccctgtctcagggactaaaggtcattgcatgtgttggtgagacacttgagcagaaggaggctgggtctaccatggaggttggtgctgcacaaacaaaagcaattgctgagaagatcaaggactggagcaacgtagttgttgcctatgaaccagtttgggctattggaact

SEQ ID NO: 195 - DNA, 241 bp, Zea mays
tcgtgctcactctacaaggagagctctgctgggagaatcaaatgaatttgttggaaacaaggttgcgtatgccctgtcttagggactaaaggtcattgcatgtgttggtgagacccttgagcagaaggaggctgggtctaccatggatgttggtgctgcacaaacgaaagcaattgctgagaagatcaaggactggagcaacgtagtttgtgcctatgaaccatgttgggctatcggaact

SEQ ID NO: 196 - DNA, 260 bp, Zea mays
atccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccat

SEQ ID NO: 197 - DNA, 398 bp, Zea mays
cagccctgaggtctctgaatctacaaggatcatctatggaggttcagtaactgctgcgaactgcaaagagctggcagcacagcctgatgtcgatggtttccttgtgggcggtgcttctttgaagcccgagttcatcgacatcatcaacgccgccgccgtgtgaagtccgctgaagatgttccaacccttcaccctgttgcggtgatgtgctgaagacagatcagactacttttttgtttaaccgtgcagtgctatgtaagctactaactttgcgctggtgcggatgctgatttccctccccctagctttttgtgaggctactctacagcttgattcagcttgctaataatgtttgcctctggacatagcgatagtggtgtttgtgtagcccttttttt

SEQ ID NO: 198 - DNA, 231 bp, Zea mays
caatttagaagcgcccctcctcctctccccatccgtgacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgtcgttgaggtcgttgtcaagcctacttatgtgttcctcccggtggtcaagagccagct

SEQ ID NO: 199 - DNA, 304 bp, Zea mays
ctgcaaagagctggcagcacagcctgatgtcgatggtttccttgtgggcggtgcttctttgaggcccgagttcatcgacatcatcaacgccgccgccgtgtgaagtccgctgaagatgttccaacccttcaccctgttgcggtgatgtgctgaagacagatcagactatttttttgtttaaccgtgcagtgctatgtaagctactaactttgcgctggtgcggatgctgatttccctccccctagctttttgtgaggctactctacagcttgattcagcttgctaataatgtttgcctctggac

SEQ ID NO: 200 - DNA, 463 bp, Zea mays
  unsure (1)..(463): unsure at all n locations
agccngcgctacagaacaggcagcaccgtcgctctggcctggcacctttgggctggtttatgtgcttgtggatgtgcgggtggatgtgcgggctacgcagttagtcgtgttaagagccttaagccgtcgtctagaatcgtcgggcgaagaagggaggcgtacctatcggcgaaaccagcgtcgaaacgtctgctaattccggtgcctttcgggctacctccggatatctcgaaaggagagtctcgtcgggagaactaaacgagcccgccggagataaggccgtccccgtctcgctctagggatcaaaggctaccgtacgcgccggcgagatttccgaggagagggaggtcggcctaattacggacgccgccgtcgtataaataaaagtaaccgtcgagaagactaaggatcggagtaatgccgcctccgttcacgaattagctcgggtcaccggaatcggtaa

SEQ ID NO: 201 - DNA, 469 bp, Zea mays
  unsure (1)..(469): unsure at all n locations
agtcagcggtggctttttgattcccctgtncanatcacgnctggccccgttggacgtgtttatgtgcctgtggatgtgcgggtggatgtgcgggctacccacctatcgtgttaagagccttaagccgtggtcggagatcgtcgggcgaagaagggaggcgtacctatcggcgaaaccagcgtcgaaacgtctgctaattccggtgcctttcgggctacctccggatatctcgaaaggagagtctcgtcgggagaactaaacgagcccgccggagataaggccgtccccgtctcgctctagggatcaaaggctaccgtacgcgccggcgagatttccgaggagagggaggtcggcctaattacggacgccgccgtcgtataaataaaagtaaccgtcgagaagactaaggatcggagtaatgccgcctccgttcacgaattagctcgggtcaccggaatcggtaaagctg

SEQ ID NO: 202 - DNA, 466 bp, Zea mays
  unsure (1)..(466): unsure at all n locations
ctcgtctgctacgcctctcctgcaggacgaccaatggcttccaggaagttcttcgtgggtggcaactggaaatgcaacggtactggcgaggacgtgaagaagatcgtcaccgtgctcaaccaagccgaggtgccctctgaagacgtcgtcgaggtggtggtgagtccgcctttcgtttttctgcagcaggtcaaggggctgctgcggctggacttcgccgtcgcagcgcagaactgctgggtgcgcaagggcggcgccttcaccggcgagatcagtgctgagatgctggtaaacctgcaggtgccctgngtcattttgggacattctgagcgcagagctctgttgggtgaatccagtgattttgttgctgataaagttgcatatgcactcactcaaggtctcaaggtaattgcttgcattggtgagacccttgagcagagagaggcaggaacaacaatggatgttg

SEQ ID NO: 203 - DNA, 402 bp, Zea mays
cccacgcgtccgccctcgcgtctttgcgtacgaggacggcttctagtccctcgcctaccccgcccccgaacctggcgtctgccctaccaaccgcagcagcgacactagaatggccgcggcgccgtcatccctcgcgtcctcccacctctccccaatcgcggcggtgtccactcccgccgtcccacatcagcttcgcatcggctgctcccgccgacgcgccgggcgcatcgttgccatggctggatccggcaagttcttcgtcggaggcaactggaagtgcaatggaacaaaggactccattagcaaacttgtctctgaattgaatgctgctacccttgaaactgatgtagatgttgtggtggcaccctcatttatctatattgatcaggttaaagaattcac

SEQ ID NO: 204 - DNA, 415 bp, Zea mays
aatgggttattcttggacactctgagcgtagacatattattggtgaaaatgaggagtgtattggaaagaaggctgcatatgcattgagccaaaatgttaaggttattgcctgcataggagagctgctggaagagagggaagcaggcaaaacttttgatgtatgttttaggcagatgaaggcttttgcagatagtatttcaaactgggcagatgttgtaattgcatacgagcctgtttgggctattggaaccggaaaagttgctactcctgaacaagcccaggaagttcatgctgctgtacgcaattggctgaagaccaacatatgacccgatgttgcctctagcactcgaataatctatggaggatctgagaatgcatgcaactgtgcggagctagcaaagaaagaagatattga

SEQ ID NO: 205 - DNA, 433 bp, Zea mays
gcgattggttgacgaccaacatatcacctgatgttgcgtctagcacacgaataatctatggaggttctgtgaatgcagccaactgtgcagagctagcaaagaaagaagatatcgacggttttcttgttggtggtgcctcgttgaaggccccggacttcgccaccattatcaactcagtgaccgccaagaaagttgcagcctgatggaccaccctgtgagaaataagaggccatcagcgtgtcgcctcatctgccacgccttaaagcctgtataggaggtgatccgtgtgatggtgtgcccgtcacctcctgtttttgctgatttgcagcacggggacagaaaataatgttttgctctcgtggacctgcactgcacgtgacgaggagagttcagttgtcgtgagcgatgtacgttggggatattgtgatgtggt

SEQ ID NO: 206 - DNA, 429 bp, Zea mays
ggtggcacctccattcatctatattgatcaggttaagaattcactaactggtcggattgaggtttctgctcagaatgtgtggattggaaaaggaggagcctacaccggagagatcagtgcagaacaactggtggacatcggctgtcaatgggttattcttggacactctgagcgtagacatattattggtgaaaatgatgagtttattggaaagaaggctgcatatgcattgagccaaaatgttaaggttattgcctgcataggagagctgctggaagagagggaagcaggcaaaacttttgatgtatgttttaagcagatgaaggcttttgcagatagtatttcaaactgggcagatgttgtaattgcatacgaacctgtttgggctattggaaccggaaaagttgctacttcttgaacaacccaaga

SEQ ID NO: 207 - DNA, 298 bp, Zea mays
ccattcctccccaaaacacatcctgcgatcctcgaagcctccgccgagcatcgatcatgtcggcctactgcggcaagtacgcgggtacgttccatcgtctcctccttcgttgctgatctgcttgtgatgtcgtttggcctcgtgtgtcgtagatctacgatctactagttgttcgttgttgatgccctcagatctacctgcgtttgacgagtatgttaacgattcgtctagctctgagagacccaagggatttgcggatccttttttagatccgtacaggctcttgcggtcgtgccta

SEQ ID NO: 208 - DNA, 288 bp, Zea mays
cgctcagatctcgctgtgattgatgggtatgctaaggctaacggctatatggacgggagaacactctttgtagactgtactgtccacagatcggagtttgaaatggaatgtgtggacagaaatctggtggcctagcctaacgattcgtataggtctgagagactcgttcagttgtaggatttgtggattttttttagatccgtacaggattgtgctgtcgtgtgcccgccaagtgcttggtggttgccaaaaggtgatgcctctgatcggtttggatatgggatttgc

SEQ ID NO: 209 - DNA, 61 bp, Zea mays
ctcccagcaccacctcgccgcgatctccgtagcgtccgtcgcgtcgagcatcgatcatgtc

SEQ ID NO: 210 - DNA, 325 bp, Zea mays
agtcagatatgtaaatcgtttaaagctttgtgctagtctaatcttgatctgtggttccttttagtcatgatgtttatgccgatacaattatatataaagcagtttttggttaataaacagtaaacttcctgaattaataattaaagtttattttgtattattcaggatggcctcctgatttgataatggaagtcattttgtattattcagtatagccttggtacctggtagatagccatgcttattatgcatattgttttgcagatgagctcatcaagaatgctgcctacattggcacccccggcaagggtatccttgctgctga

SEQ ID NO: 211 - DNA, 297 bp, Zea mays
tgcaccacaggaaagcgctgccaccggcaccatgccccacccatacccagcactgaccccggaccatataaaggagcttgctgacatcgctcaccgcattgtagctccgggcaagggcatcctggctgcagacgagtccactggaagcactgccaagcgcctgcagtccattggcagcgagaacaccgaggagaacaggcgcttctaccgccaactgctgctgactgccgatgaccgtgtgaatccctgcattggaagggtgatccttttccacgagacactataccagaaggcaga

SEQ ID NO: 212 - DNA, 167 bp, Zea mays
tgtctatctggaaggcacactgctgaagctcatcattgtcacccctggccatgcttgcacccagaaattttccaatgaggaaattgccatggctatatacacagcacttcgtcgaacagtgccccctgccgtccctggggtcactttcctgtctggagggcagagtg

SEQ ID NO: 213 - DNA, 257 bp, Zea mays
ctcgagccgaatcggctcgaggtattagttagataaccgtgctagtgcttattgattgtcaagtcccactgttcttgctctaaatctgtgtctgttgttttgcagatgagctcatcaagaatgctgcctacatcggcacccctggcaagggtatccttgctgctgatgagtcaactggcaccagtggcaagcgcctttccagcatcaatgtcgagtacgtggaggagaaccggcgggctctccgtgagctcctgttc

SEQ ID NO: 214 - DNA, 273 bp, Zea mays
ggttgacaagggtttggttccattgcctggatccaacaatgaatcatggtgccaaggtcttgatggtttggcttcaaggtgtgctgagtactataagcagggggcgcgcttcgcaaagtggaggactgttgttagcatcccttgtggtccatctgcattagcagtcaaggaagcagcatggggacttgctcgatatgctgctattgctcaggataatggtttagtgccaattgtggagccagagattcttcttgatggagaccatgggatcga

SEQ ID NO: 215 - DNA, 255 bp, Zea mays
ggttgacaagggtttggttccattgcctggatccaacaatgaatcatggtgccaaggtcttgatggtttggcttcaaggtgtgctgagtactataagcagggggcgcgcttcgcaaagtggaggactgttgttagcatcccttgtggtccatctgcattagcagtcaaggaagcagcatggggacttgctcgatatgctgctattgctcaggataatggtttagtgccaattgtggagccagagattcttcttga

SEQ ID NO: 216 - DNA, 320 bp, Zea mays
agtttggttccattgcctggatccaacaatgaatcatggtgccaaggtcttgatggtttggcttcaaggtgtgctgagtactataagcagggggcgcgcttcgcaaagtggaggactgttgttagcatcccttgtggtccatctgcattagcagtcaaggaagcagcatggggacttgctcgatatgctgctattgctcaggataatagtttagtgccaattgtggagccagagattcttcttgatggagaccatgggatcgacggagctcttgaggtggcagagaaagtgtggtctgaggtgtttttctacttagccga

SEQ ID NO: 217 - DNA, 284 bp, Zea mays
cctttatcaatcaactacagacggcaagaagtttgttgactgcttgaaggatcagaatatcatgcctggcatcaaggttgacaagggtttggttccattgcctggactcaacaatgaatcatggtgccaaggtcttgatggtttggcttcaaggtgtgctgagtactataagcagggggcgcgcttcgcaaagtggaggactgttgttagcatcccttgtggtccatctgcattagcagtcaaggaagcagcatggggacttgctcgatatgctgctattgctc

SEQ ID NO: 218 - DNA, 285 bp, Zea mays
ggagaccctttatcaatcaactacaacggcaagaagtttgatgactgcttgaaggatcagaatatcatgcctggcatcaaggttgacaagggtttagttccattgcctggatccaacaatgaatcatggtgccaaggtcttgatggtttttattcaaggtgtgctgagtactataagcagggggcgcgcttcgcaaagtggaggactgttgttagcatcccttgtggtccatctgcattagcagtcaaggaagcagcatggggacttgctcgattgctgctattg

SEQ ID NO: 219 - DNA, 267 bp, Zea mays
tttggcttcaaggtgtgctgagtactataagcagggggcccgcttcgcaaagtggaggactgttgttagcatcccttggggtccatctgcattagctgtgaaggaagcagcatggggacttgctcgatatgctgctatcgctcaggataatgtcttagtgccaattgtggagccagagatccttcttgatggagaccatgggatcgaaaggactctcgagtggcagagaagtgtggctgaggtgtcttctactgcccagacaatgtc

SEQ ID NO: 220 - DNA, 83 bp, Zea mays
gtgatggtttggcttcaaggtgtgctgagtactataagcagggggcgcgcttcgcaaagtaggccgactgtctgctagcatcc

SEQ ID NO: 221 - DNA, 277 bp, Zea mays
gttgttttgcagatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccagtacatcagcggtgtgatcctcttcgaggagaccctctaccagaagaccaaggatggcaagccttttgtcgatgtcctcaaggagggaggcgt

SEQ ID NO: 222 - DNA, 203 bp, Zea mays
ggatgatggttatctttatatttgtatgttaattagtctctttgctgttaaatttcgtgtaagttggtcctgccgatggagaatcgagcagctccctttttttgttctatcaactatgctgtaattctggctatgtatcggcaaaaacaattctatatgctgagttggagtcggcaaaaattcatatatgctgagttggagac

SEQ ID NO: 223 - DNA, 158 bp, Zea mays
ccacctcgccgcgatctccgtagcctccgtcgcgtcgagcatcgatcatgtcggcctactgcggaaagtacaaggatgagctcatcaaggattgctgcctacattggcacccctggcaagggtatccttgctgctgatgagtccactggcaccattgg

SEQ ID NO: 224 - DNA, 93 bp, Zea mays
cgaccttggcaagcgttgcgccaagtactacgaggcaggtgcccgctttgccaagtggcgcgctgttctcaagattggccctaatgagccatc

SEQ ID NO: 225 - DNA, 257 bp, Zea mays
gaacaatccagtgtgcctatcagtgtccactatgaccacggcatttccaagtcagacttgcttcaagctcttgaagcgggatttgattcagtcatggtggatggttctcatctaactttaggggataacatcttatacacaaagagcatatcttccttggctcatgcaaaaggtttacttgtggaagctgagttgggtaggctctcaggctctgaagatggcatgaccgttgaagaatatgaagcaagatttactga

SEQ ID NO: 226 - DNA, 268 bp, Zea mays
ctaaagcaaggtggagtcccactggtagcatgttgcattgctgctgcagaacaatccagtgtgcctatcagtgtccactatgaccacggcatttccaagtcagacttgcttcaagctcttgaagcgggatttgattcagtcatggtggatggttctcatctaactttaggggataacatcttatacacaaagagcgtatcttccttggctcatgcaaaaggtttacttgtggaagctgagttgggtaggctctcaggctctgaagatg

SEQ ID NO: 227 - DNA, 136 bp, Zea mays
cgctgtccttctccttcggccgcgcgctgcagcagagcaccctcaagaagtgggtcggcaagaaggagaacgtcgccgccgcgcatgccaccttcgtcatccgctgcaaggccaactccgaggccgcgctgggcaa

SEQ ID NO: 228 - DNA, 207 bp, Zea mays
  unsure (1)..(207): unsure at all n locations
ggtggacaagggccttgtcccgctcgccggctccaacaacgagtcgtggtgccaggggctggacggcctggcgtcccgcgaggccgnctactaccaacaaggcgcgccggtccgccaagtgccccaccgtggcaagaatccttaacggcccttccaagttcgccgtcaaggaggccccttggggcttggaacgttaggccgcctttt

SEQ ID NO: 229 - DNA, 482 bp, Zea mays
  unsure (1)..(482): unsure at all n locations
gtggggnnnnccgaccccacctaaacnncnnatctctctccctctccgaataaccggctggacccacgcgtccgggcacttgatcagtcaaatgcaacatgtggcaagaggttatcatctattggcttgcggaacacataattgaaccgtcaggcttacaggcagctattgctgacaactgctgttcttggtgaatatatcactggcgctattcttttcgaacgagaccctttatcaatcaactacagacggcaagaagcttgttgactgcttgaaagatcagaatatcatgcctggcatcaatgttgacaagggtttgattccattgcctggatccaacaatgaatcatggtaccaaagtcttgatggcttggcttcaaggcgtgctgactactataagcaggtggcgcgcttcgcatagcgcatgactgttgctagcatccatcgtggtgcatctgcattatcagtcaatgaatcatcat

SEQ ID NO: 230 - DNA, 414 bp, Zea mays
gtaaacctcattatatcattgcaaagggaggaatcacttcatctgatattgctacaaaggcgctggaagctaaacgtgccaaagtcatgggacaagcattagctggtgtacccttgtggcagcttggtcctgagagtagatttcctggggtcccttacattgtttttcctggtaatgttggtgataacagtgctcttgctaaagtggtgaaaagttgggcttccccatctagaagttctacaaaagaaattcttcttgatgcggagaatggcggttatgctgttggtgctttcaatgtgtataaccttgagggaattgaagctgttgttgcagcagcagaggctgaaaagagtcctgctattcttcagattcatccgagtgctctaaagcaaggtggagtcccactggtagcat

SEQ ID NO: 231 - DNA, 355 bp, Zea mays
attcactataaccttgatacctggtagatagccatgctttatgcatatcgtattgcagatgagctcatcaagaatgctgactacattggcacccctgacaagggtatccttgctgctgatgagtccactggcaccattggcaagcgcctttccagcatcaatgtctagaacgttgacgagaaccgccgtgccctccgtgagctcctattctgctgccctggtgctctccagtacatcagcggtgtgatcctcttcgaggagaccctgtaccagaagaccaaggatggctagccttctgtcgatgtcctgaacgagggaggcgttctccatagcatcaaggttgacaagggcacca

SEQ ID NO: 232 - DNA, 154 bp, Zea mays
gtcctgccgatggagaatcgagcagccctttttttttgttctatcaactatgctgtaatgctggctatgtatcggcaaaaacaattctatatgctgagttggagtcggcaaaaattcatatatgctgagttggagacagcaacttgtttggatc

SEQ ID NO: 233 - DNA, 146 bp, Zea mays
ggaggccatcttcgtcgacccggccctccgcgggaagtactgcgtctgcttcgacccgctggatggctcctccaacatcgactgtggtgtctcaatcggaacggtgtgtcactgtcactcccggtggtgtttcaaaccttcttacc

SEQ ID NO: 234 - DNA, 184 bp, Zea mays
agcatccgaagaagtactcagctcgctacgtgtgctcactggtggctgatttccaccggacgctcatatatggcggggtcgcatgaacccaagggaccatctgcggctggtttatgaggcgaaccctctcagtttccttgctgaacaggctgggggtagagggtcagatggcaagatcagaatc

SEQ ID NO: 235 - DNA, 183 bp, Zea mays
agcgccagcaagcgcagcagaccaatctccaacctcacgggcgttcagggcgccgtcaatgtgcagggcgaggaccagaagccgctcgatgtcgtctccaacgaggtgttctccaactgcctcaagtcgagcgggcgcaccggcgtgatacgctcggcggcggaggacgtgcccgtagcggtg

SEQ ID NO: 236 - DNA, 342 bp, Zea mays
tcagctcgagcttctgctcgaggtcagagacaatgacaacgtgaccttagaggatgtgctgcagcctggaacaaacatgcttgctgctggctactgcatgtacggaagttcatgtagactgtgctgagcactgggaccacatcaatgagttcactctcgatccttcccttggagagttcattttgactcatccagatatcaaggttaatgataaaaacaactcgacacttcttttctatcctggctgatcgatacccctggttagcactataaaacgaaatggtactacttgagtttgggtatcacgtgttgtgcgtgcttcgttcttttcttgtgcagata

SEQ ID NO: 237 - DNA, 309 bp, Zea mays
ggaccagaagaagctcgatgtcgtctccaacgaggtgttctccaactgcctcaagtcgagcgggcgcaccggcgtgatcgcctcggaggaggaggacgtgcccgtagcggtggagcagagctactccggcaactacatcgtcgtgttcgaccctctcgacggctcctccaacatcgacgccgccgtctccactggctccatcttcggcatctacaaccccaacgacgagtgcctcgccgacgtcgacgacaatgacacccttgattcggtggagcagaggtgcatcgtgaacgtgtgccagccggggag

SEQ ID NO: 238 - DNA, 295 bp, Zea mays
accagaagaagctcgatgtcgtctccaacgaggtgttctccaactgcctcaagtcgagcgggcgcaccggcgtgatcgcctcggaggaggaggacgtgcccgtagcggtggagcagagctactccggcaactacatcgtcgtgttcgaccctctcgacggctcctccaacatcgacgccgccgtctccactggctccatcttcggcatctacaaccccaacgacgagtgcctcgccgacgtcgacgacaatgacacccttgattcggtggagcagaggtgcatcgtgaacgtgtg

SEQ ID NO: 239 - DNA, 276 bp, Zea mays
ctcaagtcgagcgggcgcaccggcgtgatcgcctcggaggaggaggacgtgcccgtagcggtggagcagagctactccggcaactacatcgtcgtgttcgaccctctcgacggctcctccaccatcgacgccgccgtctccactgctccatcttcggcatctacaaccccaacgacgagtgcctcgccgacgtcgacgacaatgacacccttgattcggtggagcagaggtgcatcgtgaacgtgtgccagccggggagcaacctgctggccgccg

SEQ ID NO: 240 - DNA, 269 bp, Zea mays
tgcagatccccaaggcgggcaagatctacgccttcaacgagggcaactacgcgctctgggacgacaagctgaagctgtacatggacagcctcaaggagcccggcgactcggggaagccctactccgcgcggtacataggcagcctcgtcggggacttccaccgcactcttctctacggagggatctacgggtaccccagggacaagaagagcaagaacggcaagctgcggcttctctacgagtgcgcccccatgagcttcatcgtcgag

SEQ ID NO: 241 - DNA, 292 bp, Zea mays
ctcggggaagccctactccgcgcggtacataggcagcctcgtcggcgacttccaccgcactcttctctacggagggatctacgggtaccccagggacaagaagagcaagaacggcaagctgcggcttctctacgagtgcgcccccatgagcttcatcgtgagcaggccggtggcaagggctctgacggccaccagagaattcttgacatcacacctacagagatccaccaaagagtgcctctgtacattgggagcgtggaggaagtggacaaggtggagaattcctggcttg

SEQ ID NO: 242 - DNA, 277 bp, Zea mays
cgcgctctgggacgacaaactgaagctgtacatggacagcctcaaggagcccggcgactcggggaagccctactccgcgcggtacatcggcagcctcgtcggcgacttccaccgcactcttctctacggagggatctacgggtaccccagggacaagaagagcaagaacggcaagctgcggcttctctacgagtgcgcccccatgagcttcatcgtcgagcaggccggtggcaagggctctgacggccaccagagaattcttgacatcacacctaca

SEQ ID NO: 243 - DNA, 268 bp, Zea mays
cgggtacccagggacaagaagagcaagaacggcaagctgcggcttctctacgagtgcgcccccatgagcttcatcgtcgagcaggccggtggcaagggctctgacggccaccagagaattcttgacatcacacctacagagatccaccaaagagtgcctctgtacattggcagcgtggaggaagtggacaaggtggagaaattcctggcttgaatgccagagctctctcatcagatggactcccgaagacatcaagtttagggaggga

SEQ ID NO: 244 - DNA, 324 bp, Zea mays
  unsure (1)..(324): unsure at all n locations
gagaccgcgagagtgtacgtgccaccaggagcagcagcagcaatggccgccgccgccaccacctcctcatcctcccacttgctcctcctctcccgccagcagngggcctccctacgatgccgcctctccttcctcggccagcccagaaggcccggcagggtcacggcccaggcgccggccgctaaggacgtgcggtgcatggcggccgtggacactactgcggcgtccacggcggcggcggagacgagccccaagtcgagcagctacgagatcgtgacgctcacgacgtggctgctgcagcaggagcggaccggcgcgatcgac

SEQ ID NO: 245 - DNA, 267 bp, Zea mays
gagagtgtacgtgccaccagcagcagcagcagcagcaatggccgccgccgccgccacctcctcatcctcccacctgctcctcctctcccgccagcaggcggcctccctacgatgccgcctctccttcctcggccagcccagaaggcccggcagggtcacggcccaggcgccggccgctaaggacgtgcggtgcatggcggccgtggacactactgcggcgtccacggcggcggcggagacgagccccaagtcgagcagctacgagat

SEQ ID NO: 246 - DNA, 310 bp, Zea mays
gtgtacgtgccacaagcagcagcagcagcagcaatggccgccgccgccgccacctcctcatcctcccacctgctcctcctctcccgccagcaggcggcctccctacgatgccgcctctccttcctcggccagcccagaaggcccggcagggtcacggcccaggcgccggccgctaaggacgtgcggtgcatggcggccgtggacactactgcggcgtccacggcggcggaggagacgagccccaagtcgagcagctacgagatcgtgacgctcacgacgtggctgctgcagcaagagcggaccggcgcga

SEQ ID NO: 247 - DNA, 255 bp, Zea mays
ccggaaccccgagtcccgcggcgacttcacatccttctctcccacatcgtcctcggctgcaagttcgtcgcctccgccgtcaacaaggccgggctcgcccagctgatcgggctcgccggcgagaccaacgtgcagggagaggagcagaagaagctggacgtcctgtccaacgaggtgttcgtcaaggccctcgtcagcagcggtcgcacctccgtccttgtgtccgaggaggcgaggaagcaacgttcgtggacc

SEQ ID NO: 248 - DNA, 313 bp, Zea mays
gggatgtgcctacagccaaattcgtgaagaaatgcaagtatcctgaggatggttcaccgcctagatccttgagatatatcggaagtatggttgctgatgtccatcgcaccttactatacgggggcatatttttgtacccagcagaccagaagagtccaaacgggaaactacgcgttctgtatgaagtcttcccgatgtcattcctgatggaacaagctggaggccaggctttcacaggcaaacaacgggcccttgaacttgctcccgctaaacttcacgacagatccccagtgttcctcgggagctacgatga

SEQ ID NO: 249 - DNA, 272 bp, Zea mays
cttgtggtccttgtgaatggtttgcagtatggttgctgatgtccatcgcaccttactatacgggggcatatttttgtacccagcagaccagaagagtccaaacgggaaactacgcgttctgtatgaagtcttcccgatgtcattcctgatggaacaagctggaggccaggctttcacaggcaaacaacgggcgcttgaacttgctcccgctaaacttcacgacagatccccagtgttcctcgggagctacgatgacgttgaggagatcaaag

SEQ ID NO: 250 - DNA, 242 bp, Zea mays
caagtatcctgaggatggttcaccgcctagatccttgagatatatcggaagtatggttgctgatgtccatcgcaccttactatacgggggcatatttttgtacccagcagaccagaagagtccaaacgggaaactacgcgttctgtatgaagtcttcccgatgtcattcctgatggaacaagctggaggccaggctttcacaggcaaacaacgggcgcttgaacttgctcccgctaaacttc

SEQ ID NO: 251 - DNA, 384 bp, Zea mays
agactaaagcatagtatcatcagcaagggggcccctttctgtaccagagcctcagatcgtgatttcgtcataagccacgctgaattttatgccgtttcagattcgtggataagtgcaagtatcctgaagatggttcaccgcctagatccctgagatatatcggtagtatggttgctgatgtccatcgcaccttactagacgggggcatatttttgtacccagcagaccagaagagtccagacgggaaactacgcgttctgtatgaagtcttcccgatgtcattcctgatggaacaagctggaggccaggctttcacaggcaaacaaagggtgtgtttcagtttcccgttctcagaccccaatccccaactgaaaaatcttgatg

SEQ ID NO: 252 - DNA, 337 bp, Zea mays
  unsure (1)..(337): unsure at all n locations
atggtcttnnccaggttcacgnacgnatgatcacatcattgatggaattaccggactcgacccatcgcgtcaggccacgcgtacagcatctcgctagcttttcttatgcattcagatcctctctctacaagagaagttcttaagcaagatggaccgcccggcagacacacacctgactgacctgatgaccatcactcaggtcattcttaactaacaaatcccttacctctattgccgctactacttcaccattctgctctaccacatcatcctatgctacaagtatatcacctccgtcagtcaacaaggccgagctctcccagctcatctgactcac

SEQ ID NO: 253 - DNA, 221 bp, Zea mays
cccacgcgtccgcggcgcgatcgacaacgagatgaccatcgtgctggccagcatatccacggcgtgcaagcagatcgcggcgctggtgcagcgcgcgcccatctccaacctcacgggcgttcacggcgccgtcaacgtgcatggcgaggaccagaagaagctcgatgtcgtctccaacgaggtgttctccaactgcctcaagtcgagcgggcgcaccggcg

SEQ ID NO: 254 - DNA, 459 bp, Zea mays
  unsure (1)..(459): unsure at all n locations
cacgggcgttcagggcgccgtcaacgtgcagggcgaggaccagaagaagctcgatgtcgtctccaacgaggtgttctccaactgcctcaagtcgagcgggcgcaccggcgtgatcgcctcggangaggaangaacttcccgttacggttggagcaagaactaactcccgggaaactaacaatccgtncgtntttcaacctnctcgaanggctcctcaaaaatcaacnccgcggttctcnacggggcncnatcttcggnatctacaaccccaacnattnantgcctcgccganttnancaanaatnanaccctnaatncgttgaacaaaagntnaatcttnaacttttgcaanccggggaaccanctngctggcccnccgggnaactgcatttanncaacctcggtgnnttntccggctaaccnttggnaccgggggtttancttntttnacctggaccc

SEQ ID NO: 255 - DNA, 422 bp, Zea mays
  unsure (1)..(422): unsure at all n locations
ccatcgtgctggccagcatatccacggcgtgcaagcagatcgcggcgctggtgcagcgcgcgcccatctccaacctcacgggcgttcagggcgccgtcaacgtgcagggcgaggaccagaagaagctcgatgtcgtctccaacgaggtgttctccaactgcctcaagtcgagcgggcgcaccggcgtgatcgcctcggaggaggaggacgtgcccgtagcggtggagcagagctactccggcaactacatcgtcgtgttcgaccctctcgatggctcctccaacatcgacgccgccgtctccactggctccatcttcggcatctacaaccccaacgatgagtgcctcgccgacgtcgacgacaatgacacccttgattcgggtggagcanaggtgcatcgtgaacgtgtnccaaccggggga

SEQ ID NO: 256 - DNA, 419 bp, Zea mays
ctcaagtcgagcgggcgcaccggcgtgatcgcctcggaggaggaggacgtgcccgtagcggtggagcagagctactccggcaactacatcgtcgtgttcgaccctctcgacggctcctccaacatcgacgccgccgtctccactggctccatcttcggcatctacaaccccaacgacgagtgcctcgccgacgtcgacgacaatgacaccgtgagtgctaattaatctcatctcccttaccttctttctgttctgactggctcattacgtgacaattctatctccaacactacactacgtacgtacgcgcgcgcagcttgattcggtggagcagaggtgcatcgtgaacgtgtgccagccggggagcaacctgctggccgccggctactgcatgtactcgagctcggtgatcttcgtgc

SEQ ID NO: 257 - DNA, 430 bp, Zea mays
gaccgcgagagtgtacgtgccaccaggagcagcagcagcaatggccgccgccgccaccacctcctcatcctcccacttgctcctactctcccgccagcaggcggcctccctacgatgccgcctctccttcctcggccagcccagaaggcccggcagggtcacggcccatgcgccggccgctaaggacgtgcggtgcatggcggccgtggacactactgcggcgtccacggcggcggcggagacgagccccaagtcgagcagctacgagatcgtgacgctcacgacgtggctgctgcaacaggagcggaccggcgcgatcgacaacgagatgaccatcgtgctggccagcatatccacggcgtgcaagcagatcgcggcgctggtgcagcgcgcgcccatctacaacctgacgggcgttcagggcgccgtc

SEQ ID NO: 258 - DNA, 313 bp, Zea mays
accacgcgtccgcccacgcgtccgagtggacaaggtggagaaattcttgacatcacacctacagagatccaccaaagagtgcctctgtacattgggagcgtggaggaagtggacaaggtggagaaattcctggcttgaatgtccctgcttcatgccagagctctctcatcagatggactccccaagacatcaagtttagggagggaatatgtactctctctttcccaccccaaataagtcttcttcgtctcatatttcgataaatcaaacaatctcaattttgatctaatatatacacacaacattaatattt

SEQ ID NO: 259 - DNA, 296 bp, Zea mays
gctgcgtcgtgccttcgcagcacgaatcgctggatttcaagtttgttttgaagcgaaaaggtgataatcctcaatacattattgaggagggacctaaccgaccattgggttgccagagaaatgaatttgagatggggaatgcgttgtttaaactcaacgaagggaaggaggtacttgagtgcaaggttcaggttgagacagaaatgttatccccaattgacttggcggctagttggagagctcatcaggagtattttcagccttcaagggtgcgggggactcacgatgtcactatc

SEQ ID NO: 260 - DNA, 298 bp, Zea mays
caaaaggggctgttcgttgacaggggtgttggctcttctatgcttccaaaatcagccagtgcatgctccttggcatctgggtttagttttggatcagcaaagacaatgccagaagcagcaggagctgttgcagctgcagctgtagctgatcgtttgcatgggtcaaaggaggaccggaagctggccattgttttggttggcctaccagctcgtggtaaaaccttcactgcagttaagcttacaaggtaccttcgttggttgggccatgaaactagacatttcaatgttgggaagtatc

SEQ ID NO: 261 - DNA, 325 bp, Zea mays
gcgccctcgccatggaaagggagctcgcgtccatgtgggtgctcagcttcgtcgtgccgccggaccatgaaacactggacttcaagttcttgctgaagcccaaagacgctgaaaccccgtgcatcatcgaggaaggacccacacggctcctcaccggaggcatgctagagggtgatgtgagggttgcactgttcaagctcaatggagatgatgaggtgctcgagtttggggtggtcaacaaggcggaccttgtatcaccgcttgaacttgctgcaagctggagggtgtacaaggagaactttcagccttccaaagttcgggggat

SEQ ID NO: 262 - DNA, 245 bp, Zea mays
cccacgcgtccgagtgtgtgatgggatgacttatgaagagataaagaaaatcatgcccgaggaatttgagtcacgaaagaaggacaagctaagataccgctacccccgtggagaatcttacctcgatgtgatacagaggctggaacccgtcatcatcgagctagaacgccagcgtgcaccagtggttgtcatatctcatcaggctgtactgcgagcactgtatgcatatttcgcggaccgtcctt

SEQ ID NO: 263 - DNA, 268 bp, Zea mays
cccacgcgtccgcaacaaagtcctgattatgcagagcaaacagattttgaagctggtgtacaagatttcaaagagcgattgacctattatgaaaaggtctatgaaccggtggaagaaggttcttacataaaaatgattgacatggttagtgggaaggggggccaactaaagattaatgacataagtggttacttgcctggacggatcgttttcttcttgggtaactgtcatctgacacctcgtcctatcctgctaacaagacatggtg

SEQ ID NO: 264 - DNA, 280 bp, Zea mays
aaactcaaccggagatggcgagctctggcggaatctccgaccagctcttcgtctccgtcaagttagagagcccgcacctcgcggagctcgacctcgccccccacctcttcggctcccaccctgtggctggctcgtgggacccctgcaaggccctgcctttggagcgggcggccaccgccgtgtgggagttcagctgcgtcgtgccttcgcagcacgaatcgctggatttcaagtttgttttgaagcgaaaaggtgataatcctcaatacattattgaggg

SEQ ID NO: 265 - DNA, 302 bp, Zea mays
cttgtccctaggttggtatatttgacgcaacaaacagcacaagaaagcgaagatatatgctaatgaaaatggctgaaggtaactgtaagattatatttttggagacaatatgtaatgatccaaacataattgaaagaaacatacggctgaagatccaacaaagtccagactatgctgaacagctagattatgaagctggactggaggacttcaaggaacgtttgattaattatgaaaaggtctacgagccagtaggggaaggttcttacatcaaaatgattgacatggtaaaggggcaagat

SEQ ID NO: 266 - DNA, 314 bp, Zea mays
ggaagaatcggtggagactcttctttgagtgaggccggtgagctttattcaaggaagcttgcgagctttgtggagaagcgactgaaatccgagcggactgcctctatatggactagcacactccagagaacaatattaacagcacatcggatcattggatttccaaagatacaatggcgtgctcttgatgagatcaatgctggggtctgtgatgggatgacatacgatgaaataaagaaaagtaaacctgaagaatatgaatcacgaagataagacaagctgaggtatcgttatccgagagggagatcctatct

SEQ ID NO: 267 - DNA, 320 bp, Zea mays
  unsure (1)..(320): unsure at all n locations
ctcatgtagatgcgactacacaccatagtcgagatacaaatgggcgtcacgggtgtggaagagaagaggtacaaactcatggactgagtgagtacataggagcagctacttgggtgtgtcatacatcgagtacacataacacagaagcgtttgcccttctctctctctccacacggtgttcagtgtaattgctctggaaaagagacatgttgaacattgtaaaggaaaaactaataagggactgtaaaagtggcatgcgtactgtaacggataagngatacagactggggtgctcaatgcttattcagagcatattcgtc

SEQ ID NO: 268 - DNA, 265 bp, Zea mays
gtgatgggatgacatacgatgaaataaagaaaagtaaacctgatgaatatgaatcacgtagaaaagacaagctgaggcatcgttatccgagaggagaatcctatcttgacgtcattcaaagactagaacctgtgataattgaacttgaacgacagcgtgctccagttgtagtcatagctcaccaggctgtgttgagagcactttatgcatactttgcggacaaaccgcttgaggaagtcccaaatattgagatacctgtacatac

SEQ ID NO: 269 - DNA, 253 bp, Zea mays
ggtcagttacaggtaaataatatcagcggttatctccctgggaggattgtcttcatcttggtgaactctcatcttacaccacgacctattttgcttaccaggcatggtgagagtttacataatgttagaggaagagtcggtggtgatacagttctaagtgaaactggcgaactttatgcaaagaaactagccaactttatagaaaagcggctcaaatgtgagaaaacagcaactatatggaccagtacccttc

SEQ ID NO: 270 - DNA, 260 bp, Zea mays
  unsure (1)..(260): unsure at all n locations
gaaaaggtctacgagccagtaggggaaggttcttacatcaaaatgattgacatggtaaaggggcaagatggtcagttacaggtaaataatatcagcggttatctccctgggaggattgtcttcttcttggtgaactctcatcttacaccacgacctattttgcttaccaggcatggtgagagtttacataatgttagaggaagagtcggtggtgatacagttctaagtganactggcgaactttatgcaaagaaactagc

SEQ ID NO: 271 - DNA, 243 bp, Zea mays
cgggtgtggaagagaagaggtacaaactcatggactgaatgaatacataaaagcagctggttggctgtttcatacagcaagtacacataacacagaagccttttcccttctctctctctctccacacggtgttcagtgtaatttctttggaaaaaagacatgttgaacattgtaaagaaaaaactaataaggaactgtaaaaatggcatgcttactgtaacgaatagggaatacagactgggg

SEQ ID NO: 272 - DNA, 400 bp, Zea mays
ccgactcgtacgtcatgcaacaaaaccctttaatgatggaaagtacctcccggttcaggtgggacctataaactggttattttttcgcgactacaggaaggtgtggaagtacttcacgaagttgattgcttagcaactggaagatatgctatcattgatgcactaaggtggaacgttggaattatcgatgccacatacagcacacgaataccgaagaacatgctgatgaaaatggctgaaggaaaatgtcagatcatatttctgtgaacactatgtaatgaccaacatgttcttgagagaactatacaatcgaaagttcaacaaagacctgactatgcatagcatacagaatatgaagctggcgtacaagatttcaaataccgattggcctattatgaaa

SEQ ID NO: 273 - DNA, 454 bp, Zea mays
gacctttacagcagctaaacttacaagatatctccgatggttaggtcatgaaacaaaacacttcaatgttggaaagtaccgccggctcaagcatggaactaatcagactgctgatttctttcgtggagataacagggagggtgtggaggcacgtaacgaggtggctgcattagcaatggaagatatgctatcttggatgcaggagggtggtcaggttggtattttcgatgccacaaacagcacaagaatacggaggaacatgctgatgaaaatggctgaaggaaaatgtaagatcatctttttggaaacattatgtaatgaccaagatgttcttgagagaaatatacgattgaaagttcaacaaagtcctgattatgcagagcaaacagattttgaagctggtgtacaagatttcaaagagcgattgacctattatgaaaaggtctatgaaccg

SEQ ID NO: 274 - DNA, 442 bp, Zea mays
atggggaatgcgttgtttaaactcaacgaatggaaggaggtacttgagtgcaaggttgaggtggagacagaaatgttatccccatttgacttggcggctagttggagagctcatcaggagtattttcagccttcaagggtgcgagggactcacgatgtcactatcaaccctgggttagaaggcagggccaagaatggcttcgcttctggtttgaagcttgatttagacaagtatgtagttccaacaccaaacatgggctcaggtgttgtttatgcagctagtttgactgaaaatccacgctcattattgcaaactgcgagttcctcatacaatgataccacaaaggacattttgcacaactcaactaaaggcgattcatccttgaatcactatgttaacactatgaagagcacaattggagggcatgcatcgtcactggaag

SEQ ID NO: 275 - DNA, 403 bp, Zea mays
atgtatgcatatttcgcagtccgtcctttgagagaagttccagagatacagatgccactagacaccataatcgagatacaaatgggcgtcactggtgtggaagagaagaggtacaaactcatggactgaatgaatacataaaagcagctggttggctgtttcatagagcaagtacacataacatagaagccttttcccttctcactctctctccacacggtgttcattgtaatttctttggaaaaaagacatgttgaacaatgtaaacaaacaactaataacgaactgtacgaatggcatgcttactgtaacgaataacgaatacatactgggggtcaccaatgcgtagtcagaaacatattccgtcaaagaacatagcgaaatgctgcagaagaaacgcccg

SEQ ID NO: 276 - DNA, 300 bp, Zea mays
gatttattgacaacaccgatcctgctgggattgatcatcaaattgctcaactaggacctgaactggcaactactcttgtaattgtcatttctaagagcggaggcacacctgaaacccgcaatggtctactagaagtacagaaagccttcagagatgcggggctgcaattctcgaaacagggtgttgcaattactcaagaaaattctctgttggataacactgctagaatagagggatggttagctcggtttcctatgtttgattgggttggtggtaggacttcagaaatgtctgctgtgg

SEQ ID NO: 277 - DNA, 208 bp, Zea mays
cgccaaccccgacgagggtcgcatggtgggccactactggctccgcgacccggccctcgctcccaactccttcctccggaacaagatcgagaccgcactcgacaaaatcctcgccttctcccaagatgtcatctctggaaagattctttccccatctggtcgtttcacttcaattctctctataggaatcggagggtcagctttgggc

SEQ ID NO: 278 - DNA, 267 bp, Zea mays
cccacgcgtccgataacactgccagaatagagggatggttagctcggtttcctatgtttgactgggttggtggtaggacttcagaaatgtcagctgttggtttacttccagctgcattgcagtgtattgatatcaaggaaatgctatttggtgcagctttaatggatgaggaaacccggaacactgtggttaaagcaaatccagcagcattgcttgcattatgttggtattgggcatcggaagggataggcaaaaaggatatggttg

SEQ ID NO: 279 - DNA, 258 bp, Zea mays
agcttctcgcttttttaaccacagttgtcaacctaactgtcggctggagaaatggaatcagagggtctgcttatgggcctcaatttgttgctaaaccacttgcacctgataaccctccactgaaggtaagatttattgacaacatcgatcctggtgggattgatcatcaaattgctcaactaggatctcaactggcaactagctactcttgtaattgtcatttctaagaacacttgagggagggggaactgctgaagc

SEQ ID NO: 280 - DNA, 229 bp, Zea mays
gcagaatgtgaacagggccacaactgggattccttgaaatgttgatccagttgacgttgcacgaagcattaaagatttggatccagaaaccactctggtggtggctgtatcaaagacattcacaacagctgaaacaatgttaaatgctcgaactcctaaggagtggatcgtttcttctcttgggacacaggctgttgccatacatatgattgctgtcagcactaatctt

SEQ ID NO: 281 - DNA, 337 bp, Zea mays
aggttggacagcttttatccatctatgagcaccggattgcagttcagggcttcatatggggaattaactcatttgacccatggggagtggacctagggaagtcactcgcttctcaagtgaggaaacagctgcatggaacccggatggaaggaaagcctgttgagggttttaaccacagcacttcaagtttgcttgcacgatatcttgctgtcaagccatccaccccgtatgatactaccgtgctgccgaaggtgtaattactcagttgtttttgacatgccaattgctgagctctgacttggcaaggttgagcataagtctttcttcattttgggag

SEQ ID NO: 282 - DNA, 248 bp, Zea mays
gcggggctgcaattctcgaaacagggtgttgcaattactcaagaaaattctctgttggataacactgctagaatagagggatggttagctcggtttcctatgtttgattgggttggtggtaggacttcagaaatgtctgctgtgggtttacttccagctgcattgcagggtattgatatcaaggaaatgctagctggtgcagctttaatggatgaagaaacccggaacactgtggttaaagaaaatcc

SEQ ID NO: 283 - DNA, 288 bp, Zea mays
gttgcaatcactcaagaaaattctctgttggataacactgccagaatagagggatggttagctcggtttcctatgtttgactgggttggtggtaggacttcagaaatgtcagctgttggtttacttccagctgcattgcagggtattgatatcaaggaaatgctagttggtgcagctttaatggatgaggaaacccggaacactgtggtatcacattattaataacacggacaacttgcagtgatggcatgattatctatatgtgtcatgtcaacatgtttatctttt

SEQ ID NO: 284 - DNA, 243 bp, Zea mays
tgatgcgggtctgcaattctcgaaacagggtgttgcaatcactcaagaaaattctctgttggataacactgccagaatagagggatggttagctcggtttcctatgtttgactgggttggtggtaggacttcagaaatgtcagctgttggtttacttccagctgcattgcagggtattgatatcaaggaaatgctagttggtgcagctttaatggatgaggaaacccggaacactgtggttaa

SEQ ID NO: 285 - DNA, 235 bp, Zea mays
cagaaagccttcagagatgcagggctgcaattctcgaaacagggtgttgcaattactcaagaaaattctctgttggataacactgctagaatagagggatggttagctcggtttcctatgtttgattgggttggtggtaggacttcagaaatgtcagctgtgggtttacttccagctgcattgcagggtattgatatcaaggaaatgctagctggtgcagctttaatggatgagg

SEQ ID NO: 286 - DNA, 296 bp, Zea mays
cgacagaatcctcgccttctctcaagatgtcgtctctggaaagattctttccccatctggtcgtttcacttcaattctctctataggaatcggagggtcagctttgggccctcaatttgttgctgaggcacttgcgcctgataaccctccactgaagataagatttattgacaacaccgatcctgctgggattgatcatcaaattgctcaactaggacctgaactggcaactactcttgtaattgtcatttctaagagcggaggcacacctgaaacccgcaatgggctactggaag

SEQ ID NO: 287 - DNA, 228 bp, Zea mays
gaaagattctttccccatctggtcgtttcacttcaattctctctataggaatcggagggtcagctttgggccctcaatttgttgccgaggcacttgcacctgataaccctccactgaagataagatttattgacaacacagatcctgctgggattgatcatcaaattgctcaactaggacctgaactggcaactactcgtgaaagtgacatttctaagagcggcggca

SEQ ID NO: 288 - DNA, 304 bp, Zea mays
cccacgcgtccgccgcactcgacagaatcctcgccttctctcaagatgtcgtctctggaaagattctttccccatctggtcgtttcacttcaattctctctataggaatcggagggtcagctttgggccctcaatttgttgctgaggcacttgcgcctgataaccctccactgaagataagatttattgacaacaccgatcctgctgggattgatcatcaaattgctcaactaggacctgaactggcaactactcttgtaattgtcatttctaagagcggaggcacacctgaaacccgcaatgg

SEQ ID NO: 289 - DNA, 273 bp, Zea mays
ctttatgcaaatgaccgggagtctatctctgttactgtgcaagaggtaactcctagagctgttggagcactgattgcactttatgaacgtgctgtggggatttatgcttctttggtaaatatcaatgcctatcatcagcctggtgttgaggctgggaaaaaggcagcaggagaagtattggcccttcagaaaagggttctgactgtattaaaggaggccatctgcgagaaccctactgagccattgactctagatgaaattgcagatcgctgc

SEQ ID NO: 290 - DNA, 322 bp, Zea mays
ctatcatcaacctggtgttgaggctgggaaaaaggcagcaggagaagtgttggcccttcagaaaagggtgctgactgtattaaatgaggcaacctgcaaggacccttgtgagccattgactatagatgaaattgcagatcgctgccattgccctgaagatattgagatgatctacaaaatagtccagcacatggctgctaacgacagagcaatcatagcagaaggcagctgtggctctcctcgcagcgttaaggtgtacctcggtgaatgcaatgtagacgaagacttgcaggccgcgtaggttccgagcctggatccgtgt

SEQ ID NO: 291 - DNA, 264 bp, Zea mays
atcaacctggtgttgaggctgggaaaaaggcagcaggagaagtgttggcccttcagaaaagggtgctgactgtattaaatgaggcaacctgcaaggacccttgtgagccattgactatagatgaaattgcagatcgctgccattgccctgaagatattgagatgatctacaaaatagtccagcacatggctgctaacgacagagcaatcatagcagaaggcagctgtggctctcctcgcagcgttaaggtgtacctcggtgaat

SEQ ID NO: 292 - DNA, 310 bp, Zea mays
cggacgcgtggtttgagtagatatttgcaacaacttgtcatggaatctcttggaaaagaattcgacctggatggcaaccgtgttaatcaagggctaactgtatatggtaacaaaggaagcactgaccagcatgcttacattcagcagctgagagaaggtgtacaaaacttctttgttacgtttattgaggtcttgcgtgacaggcctgctggacatgattggagacttgaacctggagtcacgtgtggtgactatttgtttgggatgttgcagggaacccgttctgctctttatgcaaatgaccgggagt

SEQ ID NO: 293 - DNA, 295 bp, Zea mays
gttgcttttgagtagatatttgcaacaacttgtcatggaatctcttgggaaagaatttgatctggatggcaaccgggtaaatcaagggctatctgtatatggaaacaaaggaagtactgaccagcacgcttacattcagcagctgagagaaggtgtacacaacttctttgttacttttatcgaggtcttgcgtgacaggcctgctggtcatgattgggagcttgaacctggagtcacatgtggtgactatttgtttgggatgttgcagggaacacgttctgctctttatgcaaat

SEQ ID NO: 294 - DNA, 293 bp, Zea mays
acaaaggaagcactgaccagcacgcttacattcagcagctgagagaaggtgtacacaacttctttgttacttttatcgaggtcttgcgtgacaggcctgctggtcatgattgggagcttgaacctggagtcacatgtggtgactatttgtttaggatgttgcagggaacacgttctgctctttatgcaaatgaccgtgaatctatctctgttactgtgcaagaggtaactcctagagctgttggagcactggttgcactttatgaacgtgctgtggggctttatgcttctttg

SEQ ID NO: 295 - DNA, 281 bp, Zea mays
ggtgtacaaaacttctttgttacgtttattgaggtcttgcgtgacaggcctgctggacatgattgggagcttgaacctggagtcacgtgtggtgactatttgtttgggatgttgcagggaacccgttctgctctttatgcaaatgaccgggagtctatctctgttactgtgcaagaggtaactcctagagctgttggagcactgattgcactttatgaacgtgctgtggggatttatgcttctttggtaaatatcaatgcctatcatcagcctggtgttga

SEQ ID NO: 296 - DNA, 263 bp, Zea mays
ccggaacactgtggttaaagaaaatccagcagcattgcttgcattatgttggtattgggcatcagaagggataggcaataaggatatggttgtacttccttacaaggatagtttgttgcttttgagtagatatttgcaacaacttgtcatggaatctcttgggaaagaatttgatctggatggcaaccgggtaaatcaagggctatctgtatatggaaacaaaggaagcactgaccagcacgcttacattcagcagctgagag

SEQ ID NO: 297 - DNA, 300 bp, Zea mays
cggacgcgtggtgctagctggtgcagctttaatggatgaggaaacccggaacactgtggttaaagaaaatccagcagcattgcttgcattatgttgctattgggcatcagaagggataggcaataaggatatggttgtacttccttacaaggatagtttgttgcttttgagtagatatttgcaacaacttgtcatggaatctcttgggaaagaatttgatctggatggcaaccgggtaaatcaagggctatctgtatatggaaacaaaggaagcactgaccagcacgcttacattcagca

SEQ ID NO: 298 - DNA, 313 bp, Zea mays
cccacgcgtccgcccacgcgtccggggtattgatatcaaggaaatgctagctggtgcagctttaatggatgaagaaacccggaacactgtggttaaagaaaatccagcagcattgcttgcattatgttggtattgggcatcagaagggataggcaataaggatatggttgtacttccttacaaggatagtttgttgcttttgagtagatatttgcaacaacttgtcatggaatctcttgggaaagaatttgatctggatggcaaccgggtaaatcaagggctatctgtatatggaaacaaaggaagtactgac

SEQ ID NO: 299 - DNA, 298 bp, Zea mays
gatagtttgttacttttgagtagatatttgcctatcccttccgatgcccaataccagcagcattgcttgcattatgttggtattgggcatcggaagggataggcaaaaaggatatggttgtgcttccttataaggatagtttgttacttttgagtagatatttgcaacaacttgtcatgggatctcttggaaaagaattcgacctggatggcaaccgtgttaaacaagggctaactgtatatggtaacaaaggaagcactgaccagcatgcttacattcagcagctgagagaaggtgt

SEQ ID NO: 300 - DNA, 274 bp, Zea mays
gaggtcttgcgtgacaggcctgctggtcatgattgggagcttgaacctggagtcacgtgtggtgactatttgtttgggatgttgcagggaacccgttctgctctttatgcaaatgaccgggagtctatctctgttacgtgcaagaggtaactcctagagctgttggagcactgatttcactttatgaacgtgctgtggggatttatgcttctttggtaaatatcaatgcctatcatcagcctggtgttgaggctgggaaaaaggcagcaggaga

SEQ ID NO: 301 - DNA, 284 bp, Zea mays
cagctgcattgcagggtattgatatcaaggaaatgctagctggtgcagctttaatggatgaggaaacccggaacactgtggttaaagaaaatccagcagcattgcttgcattatgttggtattgggcatcagaagggataggcaataaggatatggttgtacttccttacaaggatagtttgttgcttttgagtagatatttgcaacaacttgtcatggaatctcttgggaaagaatttgatctggatggcaaccgggtaaatcaaggctatctgtatatggaa

SEQ ID NO: 302 - DNA, 306 bp, Zea mays
cggacgcgtggtgctagctggtgcagctttaatggatgaggaaacccggaacactgtggttaaagaaaatccagcagcattgcttgcattatactggtattgggcatcagaagggataggcaataaggatatggttgtacttccttacaaggatagtttgttgcttttgagtagatatttgcaacaacttgtcatggaatctcttgggaaagaatttgatctggatggcaaccgggtaaatcaagggctatctgtatatggaaacaaaggaagcactgaccagcacgcttacattcagcagctgag

SEQ ID NO: 303 - DNA, 271 bp, Zea mays
cccacgcgtccgcccacgcgtccgcccacgcgtccgcgaggtcttgcgtgacaggcctgctggtcatgaatgggagcttgaacctggagtcacatgtggtgactatttgtttgggatgttgcagggaacacgttctgctctttatgcaaatgaccgtgaatctatctctgttactgtgcaagaggtaactcctagagctgttggagcactggttgcactttatgaacgtgctgtggggctttatgcttctttggtaaatatcaatgcctat

SEQ ID NO: 304 - DNA, 228 bp, Zea mays
cggacgcgtgggggtgtacacaacttctttgttacgtttattgaggtcttgcgtgacaggcctgctggtcatgattgggagcttgaacctggagtcacgtgtggtgactatttgtttgggatgttgcagggaacccgttctgctctttatgcaaatgaccgggagtctatctctgttactgtgcaagaggtaactcctagagctgttggagcactgattgcactttat

SEQ ID NO: 305 - DNA, 275 bp, Zea mays
tggtgtacacaacttctttgttacttttatcgaggtcttgcgtgacaggcctgctggtcatgattgggagcttgaacctggagtcacatgtggtgactatttgtttgggatgttgcagggaacacgttctgctctttatgcaaatgaccgtgaatctatctctgttactgtgcaagaggtaactcctagagctgttggagcactggttgcactttatgaacgtgctgtggggctttatgcttcttggtaaatatcaatgctatcatcaactggtg

SEQ ID NO: 306 - DNA, 203 bp, Zea mays
tgttgtacttccttacaaggatagtttgttgcttttgagtagatatttgcaacaacttgtcatggaatctcttgggaaagaatttgatctggatggcaaccgggtaaatcaagggctatctgtatatggaaacaaaggaagcactgaccagcacgcttacattcagcagctgagagaaggtgacacaacttctttgttacttt

SEQ ID NO: 307 - DNA, 285 bp, Zea mays
  unsure (1)..(285): unsure at all n locations
gttgtcagggtattgatatcaaggaaatgctagctggtgcagctttaatggatgaagaaacccggaacactgtggttaaagaaaatccagcagcattgcttgcattatgttggtattgggcatcagaagggataggcaataaggatatggntgtacttccttacaaggatagtttgttgcttttgagtagatatttgcaacaacttgtcatggaatctcttgggaagaattgatctggatgcaaccggtaaatcaaggctatctgatatgaaacaaagaagactg

SEQ ID NO: 308 - DNA, 267 bp, Zea mays
tatcttgctgtcaagccatccaccccgtatgatactaccgtgctgccgaagtgtaattactcagttgtttttgacatgccaattgctgagttctgacttggcaaggttgagcataagtctttcttcattttgggagttatcacagagccagtttggcagtgctgtagttttggttttacctactctttgtagaagaaaagtgaagagtggatattatggaacaaaatatatacctacggcagcacgcagcatgatgaaacatattta

SEQ ID NO: 309 - DNA, 240 bp, Zea mays
gtctcccccgaccggcgatcgctatcgacttgtagcggaagccatggcgtcggcagcgctaatctgcggcacggagcagtggaaggccctccaggcgcacgtcggcgcgattcagaagacgcacctgcgcgacctgatggccgacgccgaccgatgcaaggcaatgacggctgagtatgaagggatctttctggattactcgagacagcaggcgactggtgaaacatggagaagccctta

SEQ ID NO: 310 - DNA, 292 bp, Zea mays
caaaatccggaggaactcccaggaggcgaaaagcagatccgtctcccccgagccccgaccggcgatcgctatcgacttgtagcggaagccatggcgtcggcagcgctaatctgcggcacggagcagtggaaggccctccaggcgcacgtcggcgcgattcagaagacgcacctgcgcgacctgatggccgacgccgaccgatgcaaggcaatgacggctgagtatgaagggatctttctggattactcgagacagcaggcgactggtgaaacatggagaagctcttaaattg

SEQ ID NO: 311 - DNA, 320 bp, Zea mays
ggcaagcaaacgagcggcgggacggctagcccgcaatacaaaatccggaggaactcccaggaggcgaaaagcagatccgtctcccccgagccccgaccggcgatcgctatcgacttgtagcggaagccatggcgtcggcagcgctaatctgcggcacggagcagtggaaggccctccaggcgcacgtcggcgcgattcagaagacgcacctgcgcgacctgatggccgacgccgaccgatgcaaggcaatgacggctgagtatgaagggatctttctggattactcgagacagcaggcgactggtgaaaccatggagaag

SEQ ID NO: 312 - DNA, 278 bp, Zea mays
caccgtcttccggccgtccaccgtttccagcacacagggtaaaggcaagcaaacgagcgtggggacggctagcccgcaatacaaaatccggaggaactctcaggaggcgaaaagcagatctgtctcccccgaccggcgatcgctatcgacttgtagcggaagccatggcgtcggcagcgctaatctgcggcacggagcagtggaaggcactccaggcgcacgtcggcgcgattcagaagacgcaactgcgcgacctgatggccgacgccgaccgatgc

SEQ ID NO: 313 - DNA, 105 bp, Zea mays
caaaatccggaggaactcccaggaggcgaaaagcagatccgtctcccccgagccccgaccggcgatcgctatcgacttgtagcggaagccatggcgtcggcagcg

SEQ ID NO: 314 - DNA, 267 bp, Zea mays
acccgatcaagctgtgggagcgctacgtcgagtggctctaccagcacaaggagctcggcatcttcgtcgacgtcagccggatggggttcacggaggagttcctgcggcagatggagccgcggatgcagcaggccttcgtcgacatgcgggagctcgagaagggcgccatcgccaaccccgacgagggtcgcatggtgggccactactggctccgcgacccggccctcgctcccaactccttcctccggaacaagatcgagaccgcac

SEQ ID NO: 315 - DNA, 325 bp, Zea mays
tgccatattctcaggcacttgagaagttggcaccacatatacagcagcttagcatggagagtaacgggaagggtgtttccattgatggcgcccaactttcctttgagacaggtgaaattgattttggtgaacctcgaactaatggccagcacagcttctatcaattaatccatcagggaagggttatcccttgcgactttattggtgttgttaaaagtcagcagcctgtttacttgaaaggggaaactgtgagtaatcatgatgagcttatgtccaatttctttgcccaacctgatgctcttgcttatggaaagactcctgaaca

SEQ ID NO: 316 - DNA, 316 bp, Zea mays
tccagctagggcaatattgccatattctcaggcacttgagaagttggcaccacatatacagcagcttagcatggagagtaacgggaagggtgtttccattgatggcgcccaactttcctttgagacaagtgaaattgattttggtgaacctggaactaatggccagcacagcttctatcaattaatccatcagggaagggttatcccttgcgactttattggtgttgttaaaagtcagcagcctgtttacttgaaaggggaaactgtgagtaatcatgatgagcttatgtccaatttctttgcccaacctgatgct

SEQ ID NO: 317 - DNA, 300 bp, Zea mays
  unsure (1)..(300): unsure at all n locations
atcaaagacattcacaacagctgnaaacaatgttaaatgctcgaactcttaaggagtggatcgtttcttctcttgggccacaggctgttgccaaacatatgattgctgtcagcactaatcttaagcttgtgaaggagtttggaattgacccaaacaatgcttttgccttttgggactgggttggcggccgttatagtgtttgcagtgctgttggcgttctgccattatctcttcagtatggctttccaattgtccagaaatttttggagggagcttccagtatcgacaaccacttctact

SEQ ID NO: 318 - DNA, 334 bp, Zea mays
ctcatgatgagcttatgtccaatttctttgcccaacctgatgctcttgcttatggaaagactcctgaacagttgcacagtgagaaagttccagataatcttatccctcataagacttttaagggcaaccggccatcactaagtttgcttctgcctacactatctgcatatgaggttggacagcttttatccatctatgagcaccggattgcagttcagggcttcatatggggaattaactcatttgaccactagggagtggagctagggaagtcactcgcttctcaagtgaggaaacagctgcatggaacccggatggaaggacacctgttgag

SEQ ID NO: 319 - DNA, 279 bp, Zea mays
ggtgaacctggaactaatggccagcacagcttctatcaattaatccatcagggaagggttatcccttgcgactttattggtgttgttaaaagtcagcagcctgtttacttgaaaggggaaactgtgagtaatcatgatgagcttatgtccaatttctttgcccaacctgatgctcttgcttatggaaagactcctgaacagttgcacagtgagaaagttccagaaaatcttatccctcataagacttttaagggcaaccggccatcactaagtttgctt

SEQ ID NO: 320 - DNA, 274 bp, Zea mays
tgcaaatgttgatccagttgacgttgcacgaagcattaaagatttggatccagaaaccactctggtggtggttgtatcaaagacattcacaacagcggaaacaatgttaaatgctcgaactcttaaggagtggatcgtttcttctcttgggccacaggctgttgccaaacatatgattgctgtcagcactaatcttaagcttgtgaaggagtttggaattgacccaaacaatgcttttgccttttgggactgggttggcggccgttatagtgtt

SEQ ID NO: 321 - DNA, 283 bp, Zea mays
  unsure (1)..(283): unsure at all n locations
gccacaggctgttgccaaacatatgattgctgtcagcactaatcttaagcttgtgaaggagtttggaattganccaaacaatgcttntgcctnttgggactgggttggcggccgttatagtgtttgcagtgctgttggcgttctgccattatctcttcagtatggcttgccaattgtccagaaatttttggagggagcttccagcattgacaaccactnctactcatcttcatgtgagaanaatataccngtacntcttggtgctgagtgtgtggaatgtttc

SEQ ID NO: 322 - DNA, 269 bp, Zea mays
gccacaggctgttgccaaacatatgattgctgtcagcactaatcttaagcttgtgaaggagtttggaattgacccaaacaatgcttttgccttttgggactgggttggcggccgttatagtgtttgcagtgctgttggcgttctgccattatctcttcagtatggctttccaattgtccagaaatttttggagggagcttccagcattgacaaccacttctactcatcttcatttgagaaaaatataccgtacttcttggtttgctgag

SEQ ID NO: 323 - DNA, 299 bp, Zea mays
agaagtggatcatgggttggagcaactggaaaaccgttgacaaatgttgtgtcagttggaataggtggtagctttcttggccctctatttgtgcatactgcactccagaccgatccagaagcagcagaatgtgcaaaaggccggcaactgagattccttgcaaatgttgatccagttgacgttgcacgaagcattaaagatttggatccagaaaccactctggtggtggttgtatcaaagacattcacaacagctgaaacaatgttaaatgctcgaactcttaaggagtggatcgtttc

SEQ ID NO: 324 - DNA, 276 bp, Zea mays
ttggaattgacccaaacaatgcttttgccttttgggactgggttggcggccgttatagtgtttgcagtgctgttggcgttctgccattatctcttcagtatggctttccaattgtccagaaatttttggagggagcttccagcattgacaaccacttctactcatcttcatttgagaaaaatatacctgtacttcttggtttgctgagtgtgtggaatgttcatttcttggttatccagctagggcaatatgccatatctcaggcacttgagaagt

SEQ ID NO: 325 - DNA, 255 bp, Zea mays
ctccaagagatgcagtcataaacagtgatggggtgactgtggtccctgaggtttggagtgttaaagataaaatcaagcagttttcagagacttttagaagtggatcatgggttggagcaactggaaaaccgttgacaaatgttgtgtcggttggaataggtggtagctttcttggccctctatttgtgcatactgcactccagaccgatccagaagcagcagaatgtgcaaaaggccggcaactgagattccttg

SEQ ID NO: 326 - DNA, 233 bp, Zea mays
gcacgaggttctgccattatctcttcagtatggctttccaattgtccagaaatttttggagggagcttccagcattgacaaccacttctactcatcttcatttgagagaaatatacctgtacttcttggtttgctgagtgtgtggaatgtttcatttcttggttatccagctagggcaatattgtcatattctcaggcacttgagaagttggcaccacatatacagcagctta

SEQ ID NO: 327 - DNA, 151 bp, Zea mays
aatttctttgcccaacctgatgctcttgcttatggaaagactcctgaacagttgcacagtgagaaagttccagaaaatcttatccctcataagacttttaagggcaaccggccatcactaagtttgcttctgcctacactatccgcatatg

SEQ ID NO: 328 - DNA, 115 bp, Zea mays
gtggtagctttcttggccctctatttgtgcatactgcactccagaccgatgcagaagcagcagaatgtgcaaaaggccggcaactgagattccttgcaaatgttgatccagttga

SEQ ID NO: 329 - DNA, 113 bp, Zea mays
  unsure (1)..(113): unsure at all n locations
ggagtttggaattgacccaaacaatgcttttgccttttgggactgggttggcggccgttatagtgtttgcagtgctgttggcgntctgccattatctcttcagtatggctttc

SEQ ID NO: 330 - DNA, 122 bp, Zea mays
tatcttatccctcataagacttttaagggcaaccggccatcactaagtttgcttctgcctacactatctgcatacgaggttacgacagcttttatccatctatgagcaccggattgcagttc

SEQ ID NO: 331 - DNA, 443 bp, Zea mays
  unsure (1)..(443): unsure at all n locations
agtctatctctgttactgtgcaagaggtaactcctanagctgttggagnactgattgcactttatgaacgtgctgtggggatttatgcttctttggtaaatatcaatgcctatcatcagcctggtgttgaggctgggaaaaaggcancangagaagtattggcccttcagaaaagggttctgactgtattaaaggaggccatctgcnagaaccctactgagccattgactctagatgaaattgcagatcgctgacattgccctgaagatattganatgatctacanaataatccancacatggcttctaacgacagatcacttatagcagaaggcatctgcngctttcttngcagtgttaaggtgtacctnggtgaaatgcaattttggaccnaantatgcaggccgggatagattctgngtcnggancnaagtaacattntt

SEQ ID NO: 332 - DNA, 420 bp, Zea mays
ctcttgggaaagaatttgatctggatggcaaccgggtaaatcaagggctatgtgtagatggaaacaaaggaagcactgaccagcacgcttacattcagcagctgagagaaggtgtacacaacttctttgttacttttatcgaggtcttgcgtgacaggcctgctggtcatgattgggagcttgaacctggagtcacatgtggtgactatttgtttgggatgttgcagggaacacgttctgctctttatgcaaatgaccgtgaatctatctctgttactgtgcaagaggtaactcctagagctgttggagcactggttgcactttatgaacgtgctgtggggctttatgcttctttggtaaatatcaatgcctatcatcaacctggtgttgaggctgggaaaaaggcagcaggagaagtgt

SEQ ID NO: 333 - DNA, 355 bp, Zea mays
agttcttgcggtcaagcaatcaaccccgtatgatacaaccgtgctgccgaaggtgtaattacccagttgtttttgacatgccaattgctgagttctgacttggcaaggttgagcataagtctttcttcatttgggagttatcacagagccagtttggcagtgctgtagttttggttttacctactctttgtagaagaaaagtgaagagtggatattatggaacaaaatatatacctacggcagcacgcagcatgatgaaacatatttaaaaaatttgggtgctctaccacatgcccgtggaataaaacggatgtaaactcagtgcaaaaaaaaaaaaaaaaaaaaaaaacaaaaa

SEQ ID NO: 334 - DNA, 376 bp, Zea mays
  unsure (1)..(376): unsure at all n locations
aacgagcggcgggacggctagcccgcaatacaaaatccggaggaactcccaggaggcgaaaagcagatccgtctcccccgagccccgaccggcgatcgctatcgacttgtagcggaagccatggcgtcggcagcgctaatctgcggcacggagcagtggaaggccctccaggcgcacgtcggcgcgattcagaagacgcacctgcgcgacctgatggccgacgccgaccgatgcaaggcaatgacggctgagtatgaagggatctttctggattactcgagacagcaggcgactggtgaaaccctggagaagctccttaaatgggctgacgctgcgaagctcaaggagaangatgagaagatgtttaaaggtgaaa

SEQ ID NO: 335 - DNA, 451 bp, Zea mays
ccgtatatagtgtttgcagtgctgttggcgttctgccattatctcttcagtatggctttccaattgtccagaaatttttggagggagcttccagcattgacaaccacttctactcatcttcatttgagaaaaatatacctgtacttcttggtttgctgagtgtgtggaatgtttcatttcttggttatccagctagggcaatattgccatattctcaggcacttgagaagttggcaccacatatacagcagcttagcatggagagtaacgggaagggtgtttccattgatggcgcccaactttcctttgagacaggtgaaattgattttggtgaacctggaactaatggccagcacagcttctatcaattaatccatcaaggaagggttatcccttgcgactttattggtgttgttaaaagtcagcagcctgtttacttgaaaagggaaac

SEQ ID NO: 336 - DNA, 453 bp, Zea mays
gtcatgcactggagacgttggcactacatatacagcagcttatcatggatagtaacggggggggtgtttccattgatggcgcccaactttcctttgagacaggtgaaattgattttggtgaacctggaactaatggccagcacagcttctatcaattaatccatcagggaagggttatcccttgcgactttattggtgttgttaaaagtcagcagcctgtttacttgaaaggggaaactgtgagtaatcatgatgagcttatgtccaatttctttgcccaacctgatgcacttgcttatggaaagactcctgaacagttgcacagtgagaaagttccagaaaatcttatccctcataagacttttaagggcaaccggccatcactaagtttgcttctgcctacactatccgcatatgaggttggacagcttttatccatctatgagcaccgga

SEQ ID NO: 337 - DNA, 419 bp, Zea mays
aaaatcaagcagttttcagagacttttagaagtggatcatgggttggagcaactggaaaaccgttgacaaatgttgtgtcagttggaataggtggtagctttcttggccctctatttgtgcatactgcactccagaccgatccagaagcagcagaatgtgcaaaaggccggcaactgagattccttgcaaatgttgatccagttgacgttgcacgaagcattaaagatttggatccagaaaccactctggtggtggttgtatcaaagacattcacaacagctgaaacaatgttaaatgctcgaactcttaaggagtggatcgtttcttctcttgggccacaggctgttgccaaacatatgattgctgtcagcactaatcttaagcttgtgaaggagtttggaattgacccaaacaatgc

SEQ ID NO: 338 - DNA, 460 bp, Zea mays
tcgatatgctgcaacggcaggaccaggactgggactcgcgggccgacacacgcctctacatttcttggttatacagctagggcaatattgccatattctcaggcacttgagaagttggcaccacatatacagcagcttagcatggagagtaacgggaagggtgtttccattgatggcgcccaactttcctttgagacaggtgaaattgattttggtgaacctggaactaatggccagcacagcttctatcaattaatccatcagggaagggttatcccttgcgactttattggtgttgttaaaagtcagcagcctgtttacttgaaaggggaaactgtgagtaatcatgatgagcttatgtccaatttctttgcccaacctgatgctcttgcttatggaaagactcctgaacagttgcacagtgagaaagttccagaaaatcttatccctcataagactt

SEQ ID NO: 339 - DNA, 323 bp, Zea mays
gcgaagctcaaggagaagattgagaagatgtttaaaggtgaaaagataaatagcacagagaacaggtcagtgcttcatgtagctctgagggctccaagagatgcagtcataaacagtgatggggtgaatgtggtccctgaggttcggagtgttaaagataaaatcaagcagttttcagagacttttagaagtggatcatgggttggagcaactggaaaaccgttgacaaatgttgtgtcggttggaataggtggtagctttcttggccctctatttgtgcatactgcactccagaccgatccagaagcagcagaatgtgcaaa

SEQ ID NO: 340 - DNA, 422 bp, Zea mays
  unsure (1)..(422): unsure at all n locations
ccaaaactgagtctcattacaaatgtngatcnanttgacgttgcacnaancattaaagatttggntccagaaaccacccnggtggtggttgtancaaagacattcacaacagcggaaacaatgttaaatgctcgaactcttaaggagtggatcgtttcttctcttgggccacaggctgttgccaaacatatgattgctgtcagcactaatcttaagcttgtgaaggagtttggaattgacccaaacaatgcttttgccttttgggactgggttggcggccgttatagtgtttgcagtgctgttggcgttctgccattactcttcagtatggctttccaattgtccagaaatttttggagggaacttccagncattgacaaacaacttcnantcnncctncattttgagaaaaatatacctgt

SEQ ID NO: 341 - DNA, 254 bp, Zea mays
gccgcgcacccctggcacgacctcgagatcggtcctgaagctccggccgtcttcaacgtcgtcgtggagatcaccaaggggagcaaggtgaagtacgagctggacaagaagacggggctcatcaaggtggaccggatcctctactcgtccgtcgtctaccctcacaactacggcttcgtgccccggacgctctgcgaggacaacgaccccatggacgtcctcgtgctcatgcaggaacccgtccttcccggcgc

SEQ ID NO: 342 - DNA, 205 bp, Zea mays
tttgtttcctgctctggccaaattccagacaagaagaacgagaacaaggaggtggccgtcaacgacttcctgcccgccgccgctgcccgcgaagcatccagtactccatgtaaagtcgccctgctcatttatctcgtggatgacttgaaaaaaaacgaggtttggattctgggactctgcattcgtacgtgttgacatggatctt

SEQ ID NO: 343 - DNA, 241 bp, Zea mays
tcgacatgtgtgaatatggagcgtgtctgacgatccttccggtgcgcgtccgtccgtccgttacgtacgtggtgccgacgagcaggtcgtggagatcaccaaggggagcaaggtgaagtacgagctggacaagaagacggggctcatcaaggtggaccggatcctctactcgtccgtcgtctaccctcacaactacggcttcgtgccccggacgctctgcgaggacaacgaccccatggac

SEQ ID NO: 344 - DNA, 324 bp, Zea mays
ggttcctgccttgaacgaaaggatactgtcatccatgtccaggaggtctgttgctgcacacccttggcatgatctggagataggtcctggtgctccaaccatattcaactgcgtaaggccaccctgtcatgcttgactggtcctcttgtgatatgttcatgttaatagcatgatgtcttttgttctattggaaaataaaaagtctccctggactctaaaatcaatgcctgtgaacacatgaactgtttgtgtcacccatgttcctctgctccttggcactttctgatgcatgctcaaatgcttaagaaagactcatagaagcga

SEQ ID NO: 345 - DNA, 123 bp, Zea mays
ctccgcgccagggccatcggcctcatgcctatgatagatcagggagagaaggacgacaagatcatcgccgtctgcgccgacgaccccgagtaccgccactacaacgacatcagcgagctctcc

SEQ ID NO: 346 - DNA, 286 bp, Zea mays
ggccgctccgccaccccgcactcgcctgtcgcctcttctcgctttcgccaccggggcagcgctccggtgagtggcgaagggcccctcccggctcccgcttccctctgccatggctggacctgctgttctcaatgagcgtatcctttcttccatgtcccagaaacatgttgctgctcaaccatagcatgatttggagataggaccaggggctcctgaattcttcaattgtgtggttgagattcctagaggcagcaaggttaagtacgagttggacaaggcatctggt

SEQ ID NO: 347 - DNA, 289 bp, Zea mays
  unsure (1)..(289): unsure at all n locations
cttgcagggagagaaggacgacaagatcatcgccgtctgcgccgacgaccccgagtaccgccactacaacgacatcagcgagctctcccctcaccgcctccaggagatccgccgcttctttgaagactgtacgcgcgcttgctctctctctctctctctgggggcgcgctttctggngnctctctctctctctctatctctcggcgctcgctgtgtgcgcgcgcggtgctctgtgagcgcgcgcgcccctctgtatgagtgcgtgtgtgggtgttgtgtctcgcgctct

SEQ ID NO: 348 - DNA, 96 bp, Zea mays
ggaggtccgtagctgctcatccgtggcatgatcttgagatcggtcctgatgctcctgctgtttccgaatgttgttgttcagatcacaaagggaagc

SEQ ID NO: 349 - DNA, 199 bp, Zea mays
tagcgagtaatcggatcgtcaggagtccgtagtgtcatccgggatgatcttgagatcggtctgatgctctgctgttatcaatgttgttgttgagatcacaaagggaagcaacataaaatatgagctcgacaagaaaactggactgattaaggttgatcgagtcctgcactcatcagttgtatacccacacaattatggt

SEQ ID NO: 350 - DNA, 284 bp, Zea mays
agcgacacggttggagacccattcaaagaagtacattgagactggtgcccttggtggcaaaggcagtgagtcccataaggctgcggttacaggcgacacggttggagacccattcaaagacactgcaggaccatcgctgcacgttcttatcaagatgctcgccacgatcacactggtcatggctcccatattcttgtgattaaccaaccagatttatcaagcttgccattaaccctgcggagatgtatctatgcgacttgtagatgaggtgtttacctgcatgt

SEQ ID NO: 351 - DNA, 132 bp, Zea mays
gcactgagaactcgatcgctggctagaacacaggtctctcattcacttccatgcgctccgtggccatcgccgtccccgaccgcagcgcaggactgaggataaatgaagaagttaaggttgctgcttctgctg

SEQ ID NO: 352 - DNA, 333 bp, Zea mays
gccaccgatcgctcctctccactttccacattccagttccactccgcctccgctgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactg

SEQ ID NO: 353 - DNA, 340 bp, Zea mays
ctccgctgccggtcgccgactccgaaactccgacagtccgaccacaaggatccacagaaggatgagtgaagaggataaggctgctgcttctgctgagcagccgaagagggcccctaagctcaatgaaaggatcctctcttctctgtccaggaggtccgtagctgctcatccgtggcatgatcttgagatcggtcctgatgctcctgctgttttcaatgttgttgttgagatcacaaagggaagcaaagttaaatatgagctcgacaagaaaactggactgattaaggttgatcgagtcctgtactcatcagttgtataccctcacaattatggttcgtcc

SEQ ID NO: 354 - DNA, 322 bp, Zea mays
gccaccgatcgctcctctccactttccacattccagttccactccgcctccgctgccggtcgccgactccgaaactccgacagtccgaccacaagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactggactgatta

SEQ ID NO: 355 - DNA, 357 bp, Zea mays
  unsure (1)..(357): unsure at all n locations
ccccancgatcgctcctctccactttccacattccagttccaacacgcctccgctgcaggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactggactgattaaggttgatcgagtc

SEQ ID NO: 356 - DNA, 309 bp, Zea mays
accagggtgaaaaggatgacaagataatagcagtctgtgctgatgatcctgaatatcgtcactacaacgacatcagtgagctgtctcctcatcgcctgcaagagatcaagcggttctttgaagattataagaagaatgagaataaagaggttgctgtcgatgcattcttgcctgcgaccacagctcgagaggccattcagtactccatggatctgtatgcgcagtatattttgcaaagcttgaggcagtagattggaagcaactatttatctgggcgtcttggaatgagtgtgattttaataagtcaaa

SEQ ID NO: 357 - DNA, 312 bp, Zea mays
caaagttaaatatgagcttgacaagaaaactggactgattaaggttgatcgagtcctgtactcatcagttgtataccctcacaattatggtttcgttccaaggactctttgtgaagacaatgacccaatggatgtgttagtcctgatgcaggagcctgttgttcctggttcgttcctgcgagcaagagcaatcggccttatgctcatgattgaccagggtgaaaaggatgacaagataatagcagtctgtgctgatgatcctgaatatcgtcactacaacgacatcagtgagctgtctcctcatcgcctgca

SEQ ID NO: 358 - DNA, 298 bp, Zea mays
tcgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactggactgattaaggttgatcgagtcctgtactcatcagttgta

SEQ ID NO: 359 - DNA, 297 bp, Zea mays
gcctccgctgccggtcgccgactccgaaactccgacagtccgaccacaaggatccacagaaggatgagtgaagaggataaggctgctgcttctgctgagcagccgaagagggcccctaagctcaatgaaaggatcctctcttctctgtccaggaggtccgtagctgctcatccgtggcatgatcttgagatcggtcctgatgctcctgctgttttcaatgttgttgttgagatcacaaagggaagcaaagttaaatatgagctcgacaagaaaactggactgattaaggttgatcga

SEQ ID NO: 360 - DNA, 287 bp, Zea mays
ctccactttccacattccagttccactccgcctccgctgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagca

SEQ ID NO: 361 - DNA, 282 bp, Zea mays
gagcactttccacattccagttccactccgcctccgctgccggtcgccgtctccgagactccgacagtccgaccgcaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaaggg

SEQ ID NO: 362 - DNA, 297 bp, Zea mays
ttaaggttgatcgagtcctttactcatcagttgtataccctcacaattatggtttcattccaaggactacttgtgaagacaatgacccaatggatgtgttggtcctgatgcaggagcctgttgttcctggttcgttcctgagagctagagcaattggccttatgcccatgattgaccagggtgaaaaggatgacaagataatagcagtatgtgctgacgatcctgaataccgtcactacaacgacatcagcgagctgtctcctcaccgcctgcaagagatcaagcgcttctttgaag

SEQ ID NO: 363 - DNA, 279 bp, Zea mays
ctcgagccgctccactttccacattccagttccactccgcctccgctgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttga

SEQ ID NO: 364 - DNA, 272 bp, Zea mays
gcggttctttgaagattataagaagaatgagaataaagaggttgctgtcgatgcattcttgcctgcgaccacagctcgagaggccattcagtactccatggatctgtatgcgcagtatattttgcaaagcttgaggcagtagattggaagcaactatttatctgggcgtcttggaatgagtgtgattttaataagtcaaaacacttgatattgtgtgcaaatcttggggttgagaacaatgtcactagctgtgatttacttctgtgacttgc

SEQ ID NO: 365 - DNA, 292 bp, Zea mays
ccacattccagttccactccgcctccgctgccggtcgccgactccgaaactccgacagtccgaccacaaggatccacagaaggatgagtgaagaggataaggctgctgcttctgctgagcagccgaagagggcccctaagctcaatgaaaggatcctctcttctctgtccaggaggtccgtagctgctcatccgtggcatgatcttgagatcggtcctgatgctcctgctgttttcaatgttgttgttgagatcacaaagggaggcaaagttaaatatgagctcgacaagaa

SEQ ID NO: 366 - DNA, 266 bp, Zea mays
ccactttccacattccagttccactccgcctccgctgccggtcgccgactccgaaactccgacagtccgaccacaaggatccacagaaggatgagtgaagaggataaggctgctgcttctgctgagcagccgaagagggcccctaagctcaatgaaaggatcctctcttctctgtccaggaggtccgtagctgctcatccgtggcatgatcttgagatcggtcctgatgctcctgctgttttcaatgttgttgttgagatcacaaa

SEQ ID NO: 367 - DNA, 284 bp, Zea mays
ccacattccagttccactccgcctccgctgccggtcgccgactccgaaactccgacagtccgaccacaaggatccacagaaggatgagtgaagaggataaggctgctgcttctgctgagcagccgaagagggcccctaagctcaatgaaaggatcctctcttctctgtccaggaggtccgtagctgctcatccgtggcatgatcttgagatcggtcctgatgctcctgctgttttcaatgttgttgttgagatcacaaagggaagcaaagttaaatatgagctc

SEQ ID NO: 368 - DNA, 341 bp, Zea mays
ccaggttgctcctcatttccactttccactgcgcctccgctgcccatcgccgtccccgaccgcagcgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcatatacgagcttgacaagaaaactggactgattaaggttgatcgagtcctttactcatcagttgtatacctcac

SEQ ID NO: 369 - DNA, 269 bp, Zea mays
attccactccgcctccgtgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagacgccaaagggaagcaaa

SEQ ID NO: 370 - DNA, 255 bp, Zea mays
cctcacaattatggtttcgttccaaggactctttgtgaagacaatgacccaatggatgtgttagtcctgatgcaggagcctgttgttcctggttcgttcctgcgagcaagagcaatcggccttatgcccatgattgaccagggtgaaaaggatgacaagataatagcagtctgtgctgatgatcctgaatatcgtcactacaacgacatcagtgagctgtctcctcatcgcctgcaagagatcaagcggttcttt

SEQ ID NO: 371 - DNA, 285 bp, Zea mays
ctcctctccactttccacattccagttccactccgcctccgctgccggtcgccgactccgaaactccgacagtccgaccacaagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcagagttaaatatga

SEQ ID NO: 372 - DNA, 267 bp, Zea mays
agactccgaaactccgacagtccgaccacaagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaatgttaaatatgatcttgacaagaatactggactgatgaaggttgat

SEQ ID NO: 373 - DNA, 266 bp, Zea mays
ggaggtccgtagctgctcatccgtggcatgatcttgagatcggtcctgatgctcctgctgttttcaatgttgttgttgagatcacaaagggaagcaaagttaaatatgagctcgacaagaaaactggactgattaaggttgatcgagtcctgtactcatcagttgtataccctcacaattatgtgttcgttccgaggactctttgtgaagacaatgacccaatggatgtgttagtcctgatgcaggagcctgttgttcctggttcg

SEQ ID NO: 374 - DNA, 253 bp, Zea mays
gctgatgatcctgaatatcgtcactacaacgacatcagtgagctgtctcctcatcgcctgcaagagatcaagcggttctttgaagattataagaagaatgagaataaagaggttgctgtcgatgcattcttgcctgcgaccacagctcgagaggccattcagtactccatggatctgtatgcgcagtatattttgcaaagcttgaggcagtagattggaagcaactatttatctgggcgtcttggaatgagtg

SEQ ID NO: 375 - DNA, 303 bp, Zea mays
gctgccgatcgccgtccccgaccgcagtgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagaaaactggactgattaaggttgatcgagtcctttactcatcagttgtataccctca

SEQ ID NO: 376 - DNA, 285 bp, Zea mays
cgaccaccgatcgctcctgagcactttccacattccagttccacaccgcctccgctgacggtcgccgtctccgagactccgacagtccgaccgcaagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagca

SEQ ID NO: 377 - DNA, 303 bp, Zea mays
  unsure (1)..(303): unsure at all n locations
aagnaccaccgatcgctcctctccactttccacattccagttccactccgcctccgctgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaaggga

SEQ ID NO: 378 - DNA, 303 bp, Zea mays
acgcctccgctgccgatcgccgtccccgaccgcagtgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagaaaactggactgattaaggttgatcgagtcctttactcatcagttgta

SEQ ID NO: 379 - DNA, 267 bp, Zea mays
attccaaggactctttgtgaagacaatgacccaatggatgtgttggtcctgatgcaggagcctgttgttcctggttcgttcctgagagctagagcaattggccttatgcccatgattgaccagggtgaaaaggatgacaagataatagcagtatgtgctgacgatcctgaataccgtcactacaacgacatcagcgagctgtctcctcaccgcctgcaagagatcaagcgcttctttgaagattacaagaaaaacgagaacaaagaa

SEQ ID NO: 380 - DNA, 263 bp, Zea mays
cctggtgctcctgctgtattcaatgttgttgttgagatcacaaagggaagcaaagtcaaatacgagcttgacaagaaaactggactgattaaggttgatcgagtcctttactcatcagttgtataccctcacaattatggtttcattccaaggactctttgtgaagacaatgacccaatggatgtgttggtcctgatgcaggagcctgttgttcctggttcgttcctgagagctagagcaattggccttatgcccatgattga

SEQ ID NO: 381 - DNA, 273 bp, Zea mays
agcctccgctgccggtcgccgactccgaaactccgacagtccgaccacaagcaggatgagtgaagaggataagactgctgcttctgctgagcagccgaagagggcccctaagctcaatgaacggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactggact

SEQ ID NO: 382 - DNA, 276 bp, Zea mays
gtagctgctcatccatggcatgatcttgagatcggtcctgatgctcctgctgttttcaatgttgttgttgagatcaacagcgaagcaaagttaaatatgagcttgacaagaaaactggactgattaaggttgatcgagtcctgtactcatcagttgtataccctcacaattatggtttcgttccaaggactctttgtgaagacaatgacccaatggatgtgttagtcctgatgcaggagcctgttgttcctggttcgttcctggagcaagagcatc

SEQ ID NO: 383 - DNA, 283 bp, Zea mays
ccactttccactgcacctccgctgcccatcgccgtccccgaccgcagcgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagaaaactggactgatta

SEQ ID NO: 384 - DNA, 251 bp, Zea mays
ctccgcctccgctgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcac

SEQ ID NO: 385 - DNA, 263 bp, Zea mays
ctttccactccgcctccgctgccgatcgccgtccccgaccgcagtgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaa

SEQ ID NO: 386 - DNA, 296 bp, Zea mays
  unsure (1)..(296): unsure at all n locations
gccgatcgccgtccccgaccgcagtgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcanatacgagcttgacaagaagactggactgattaaggttgatcgagtcctttactcatcagttgtatacc

SEQ ID NO: 387 - DNA, 221 bp, Zea mays
gtcattcagtactccatggatctgtatgcgcagtatattttgcaaagcttgaggcagtagattggaagcaactatttatctgggcgtcttggaatgagtgtgattctaataagtcaaaacacttgatattgtgtgcaaatcttggggttgagaacaatgtcactagctgtgatttacttctgtgacttgcattttttttcttgttaaattatgaataagcg

SEQ ID NO: 388 - DNA, 313 bp, Zea mays
ctcatttccactttccactgcgcctccgctgcccatcgccgtccccgaccgcagcgcaggtgaggatccaaccccaacaaacttccaggcgacggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagaaaa

SEQ ID NO: 389 - DNA, 336 bp, Zea mays
ctactttccactccgcctccgctgccgatcgccgtccccgaccgcagtgcaggtgaggatccaaccccaacaaacttccaggcgacggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagataactggactgattaaggttgatcgagtccttt

SEQ ID NO: 390 - DNA, 247 bp, Zea mays
ggatgacaagataatagcagtatgtgctgacgatcctgaataccgtcactacaacgacatcagcgagctgtctcctcaccgcctgcaagagatcaagcgcttctttgaagattacaagaaaaacgagaacaaagaagtcgcagttgatgcattcttgcccgcgacaacagctcaagaagccattcagtactccatggacctgtatgcccagtatattttgcaaagcttgaggcagtagattgcaagc

SEQ ID NO: 391 - DNA, 221 bp, Zea mays
caatgttgttgttgagatcacaaagggaagcaaagtcaaatacgagcttgacaagaaaactggactgattaaggttgatcgagtcctttactcatcagttgtataccctcacaattatggtttcattccaaggactctttgtgaagacaatgacccaatggatgtgttggtcctgatgcaggagcctgttgttcctggttcgttcctgagagctagagcaa

SEQ ID NO: 392 - DNA, 263 bp, Zea mays
gtagtgacgatattcaggatcatcagcacagactgctagagatcaagcggttctttgaagattataagaagaatgagaataaagaggttgctgtcgatgcattcttgcctgcgaccacagctcgagaggccattcagtactccatggatctgtatgcgcagtatattttgcaaagcttgaggcagtagattggaagcaactatttatctgggcgtcttggaatgagtgtgattttaataagtcaaaacactgatattgtgtgc

SEQ ID NO: 393 - DNA, 258 bp, Zea mays
agcggagaacgaccccacggtgacgacatgcttgctctgctggactgttactctgagtaagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactgg

SEQ ID NO: 394 - DNA, 209 bp, Zea mays
caagaaaactggactgattaaggttgatcgagtcctgtactcatcagttgtataccctcacaattatggtttcgttccaaggaatctttgtgaagacaatgacccaatggatgtgttagtcctgatgcaggagcctgttgttcctggttcgttcctgcgagcaagagcaatcggccttatgcccatgattgaccagggtgaaaaggatg

SEQ ID NO: 395 - DNA, 274 bp, Zea mays
ctcatttccactttccactccgcctccgctgccgatcgccgtccccgaccgcagtgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgtggttgagatcacaaggggaagccaagtcaatacgagcttgacaaga

SEQ ID NO: 396 - DNA, 240 bp, Zea mays
tcctgatgcaggagcctgttgttcctggttcgttcctgagagctagagcaattggccttatgcccatgattgaccagggtgaaaaggatgacaagataatagcagtatgtgctgatgatcctgaataccgtcactacaacgacatcagcgagctgtctcctcaccgcctgcaagagatcaagcgcttctttgaagattacaagaaaaacgagaacaaagaagtcgcagttgatgcattct

SEQ ID NO: 397 - DNA, 313 bp, Zea mays
tccgcctccgctgccgatcgccgtccccgaccgcagtgcaggactgaggatgagtgaagaggataaggctgctgcttctgctgagcagcctaagagggcacctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagataactggactgattaaggttgatcgagtcctttactcatcagttgtataccctcac

SEQ ID NO: 398 - DNA, 187 bp, Zea mays
caaggtcttgtgtgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgtt

SEQ ID NO: 399 - DNA, 243 bp, Zea mays
ggatccaaccccaacaaacttccaggcgacggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaaaggaaagcaagtcaaatacgagcttgac

SEQ ID NO: 400 - DNA, 261 bp, Zea mays
gttctagatcgcgagcaagagatcaagcggttctttgaagattataagaagaatgagaataaagaggttgctgtcgatgcattcttgcctgcgaccacagctcgagaggccattcagtactccatggatctgtatgcgcagtatattttgcaaagcttgaggcagtagattggaagcaactatttatctgggcggcttggaatgagtgtgatcctaataagccaaaacacttgatattgtgtgcaaatcttggggttgaga

SEQ ID NO: 401 - DNA, 285 bp, Zea mays
gcgcctccgctgcccatcgccgtccccgaccgcagcgcaggtgaggatccaaccccaacaaacttccaggcgacggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagccaagtcaaatacgagcttt

SEQ ID NO: 402 - DNA, 222 bp, Zea mays
cccacgagtccgcccacgcgtccgaaagaggttgctgacgatgcattcttgcctgcgaccacagctcgagaggccattcagtactccatggatctgtatgcgcagtatattttgcaaagcttgaggcagtagattggaagcaactatttatctgggcgtcttggaatgagtgtgattttaataagtcaaaacacttgatattgtgagcaattcggggggttg

SEQ ID NO: 403 - DNA, 287 bp, Zea mays
attggaagcaactatttatctgggcgtcttggaatgagtgtgattttaataagtcaaaacacttgatattgtgtgcaaatcttggggttgagaacaatgtcactagctgtgatttacttctgtgacttgcattttttttcttgttaaattatgaataagcgaagtccatacgtctactgtgtggcttcttgctgggttcatcgtctacccatgttcctcaagcttgggaacatggggcctttccccatttccgtgtcttccatgcgaagtaaaatttatttgtatac

SEQ ID NO: 404 - DNA, 176 bp, Zea mays
gggaagcaaagtcaaatacgagcttgacaagaaaactggactgattaaggttgatcgagtcctttactcatcagttgtataccctcacaattatggtttcattccaaggactctttgtgaagacaatgacccaatggatgtgttggtcctgatgcaggagcctgttgttcctggtt

SEQ ID NO: 405 - DNA, 151 bp, Zea mays
tccagttccactccgcctccgctgccggtcgccgactccgaaactccgacagtccgaccacaaggtcttgtgcgggatccacagaaggatgagtgaagaggataagactgctgcttctgctgagcagccgaagagggcccctaagctcaat

SEQ ID NO: 406 - DNA, 263 bp, Zea mays
gaacaaagaagtcgcagttgatgcattcttgcccgcgacaacagctcaagaagccattcagtactccatggacctgtatgcccagtatattttgcaaagcttgaggcagtagattgcaagcaacaatttatctatcatgcgtcttggatcggggcgtgattttaataagccgaatcgcttgctatattgcgaaccttggaattgagaacagcgtcactagctgtgattcgctcctttctcgttaaattatcatatgaataggc

SEQ ID NO: 407 - DNA, 237 bp, Zea mays
gcacgagagaagtcgcagttgatgcattcttgcccgcgacaacagctcaagaagccattcagtactccatggacctgtatgcccagtatattttgcaaagcttgaggcagtagattgcaagcaacaatttatctatcatgcgtcttggatgggggcgtgattttaataagccaaatcgcttgctatattgggaaccttggaattgagaacagcgtcactagctgtgattcgctcctt

SEQ ID NO: 408 - DNA, 166 bp, Zea mays
cggacgctgggcgagtcctttactcatcagttgtataccctcacaattatggtttcattccaaggacactttgtgaagacaatgacccaatggatgtgttggtcctgatgcaggagcctgttgttcctggttcgttcctgagagctagagcaattggccttatgcc

SEQ ID NO: 409 - DNA, 237 bp, Zea mays
cagacgcgtggccgctgcccatcgccgtccccgaccgcagcgcaggtgaggatccaaccccaacaaaattccaggcgacggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgt

SEQ ID NO: 410 - DNA, 137 bp, Zea mays
gtagctgctcatccatggcatgatcttgagatcggtcctgatgctcctgctgttttcaatgttgttgttgagatcacaaagggaagcaaagttaaatatgagcttgacaagaaaactggactgattaaggttaaccg

SEQ ID NO: 411 - DNA, 191 bp, Zea mays
acactgcacctccgctgcccatcgccgtccccgaccgcagcgcaggactagtatgaggataaggctgctgcttctgctgagcagcctaagagggcccctaagctcaatgaaaggatcctctcctctctgtccaggaggtccgtagctgctcatccatggcatgatctcgagatcggtcctggtgctcctgc

SEQ ID NO: 412 - DNA, 136 bp, Zea mays
gtgttggtcctgatgcaggagcctgttgttcctggttcgttcctgagagctagagcaattggccttatgcccatgattgaccagggtgaaaaggatgacaagataatagcagtatgtgctgacgatcctgaatacc

SEQ ID NO: 413 - DNA, 160 bp, Zea mays
acggcccacctggaagccggagagaatcgagcagagccaccgatcgctcctctccactttccacattccagttccactccgcctccgctgccggtcgccgactccgaaactccgacagtccgaccacaaggatccacagaaggatgagtgaagaggataa

SEQ ID NO: 414 - DNA, 155 bp, Zea mays
cgctcctctccactctccacattccagttccactccgcctccgctgccggtcgccgactccgatactccgacagtccgaccacaaggtcttgtgcgggatccacagaaggatgagtgaagaggataagactgctgcttctgctgagcagccgaag

SEQ ID NO: 415 - DNA, 135 bp, Zea mays
ccaggttgctcctcatttccactttccactgcggctccgctgcccatcgccgtccccgaccgcagcgcaggactgaggatgagtgaagaggataaggctgctgcttctgctgagcagcctaagagggcccctaag

SEQ ID NO: 416 - DNA, 186 bp, Zea mays
agagaatcgagcagagccacccggctgctcctcatttccactttccactccgcctccgctgccgatcgccgtccccgaccgcagtgcaggactgaggatgagtgaagaggataaggctgcagcttctgctgagcagcctaagagggcccctaagctcaatgaaaggatcctctcctctctgtccag

SEQ ID NO: 417 - DNA, 303 bp, Zea mays
aaccgctccgccacctcgccactcgcctcttctcgctctcgccaccgggccagggaagggaccatccgatcggatccgtcatggctggagctgctgctctcaatgagggtatcctttcttccgtgtccgagaaaaatgttgctgctcacccatggcatgatttggagataggaccagaggctcctgcagtgttcaattgtgtggttgagattcctagaggcagcaaggttaagtatgagttggacaagatatctggtctgatcaaggtggatcgtgtcctttactcctctgttgtttacccac

SEQ ID NO: 418 - DNA, 290 bp, Zea mays
ctcgaggccgctccgccacctcgccactcgcctcttctcgctctcgccaccgggccagggaagggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggttaagtatgagttggacaagatatctggtctgatcaaggtggatcgtgtcctttact

SEQ ID NO: 419 - DNA, 309 bp, Zea mays
tggacagcagcagtgaactcgacgccgctccgccacctcgccactcgcctcttctcgctctcgccaccgggccagggaagggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggttaagtatgagttggacaagatatctggtctgatcaaggtggatcgtgtcctttactcc

SEQ ID NO: 420 - DNA, 258 bp, Zea mays
ctcgaggccgctccgccacctcgccactcgcctcttctcgctctcgccaccgggccagggaagggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggttaagtatgagttggacaagatatc

SEQ ID NO: 421 - DNA, 293 bp, Zea mays
tgcagcagtgaactcgaggccgctccgccacctcgccactcgcctcttctcgctctcgccaccgggccaggtgaagggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggttaagtatgagttggacaagatatctggtctgatcaaggtggatcgt

SEQ ID NO: 422 - DNA, 315 bp, Zea mays
gccctggacagcagcagcgaactcgaggccgctccgccacctcgccactcgcctcttctcgctctcgccaccgggccaggggcgggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggttaagtatgagttggacaagatatctggtctgatacaggtggatcgtgtcctttactcctc

SEQ ID NO: 423 - DNA, 254 bp, Zea mays
ctcgaggccgctccgccacctcgccactcgcctcttctcgctctcgccaccgggccagggaagggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggttaagtatgagttggacaaga

SEQ ID NO: 424 - DNA, 266 bp, Zea mays
cgccccggagccctggacagcagcagtgaactcgaggccgctccgccacctcgccactcgcctcttctcgctctcgccaccgggccagggaagggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggtta

SEQ ID NO: 425 - DNA, 260 bp, Zea mays
ggagccctggacagcagcagtgaactcgaggccgctccgccacctcgccactcgcctcttctcgctctcgccaccgggccagggaacggaccatccgatcggctccgtcatggctggagctgctgctctcaatgagggtatcctttcttccgtgtccgagaaaaatgttgctgctcacccatgcattgatttggagataggaccagaggctcctgaagtgttcaattgtgtggttgagattcctagaggcagcaaggtta

SEQ ID NO: 426 - DNA, 278 bp, Zea mays
gttgccattatatcagcatattggctggggcagacctctggcttggtggacgagtctggcaacccaactggtggtctttttgggacagctgtagcaacaatggggatgcttagcactgcagggtatgttctcaccatggacatgtttggtcctatagctgacaacgctggtggtattgttgagatgagccagcagcctgaaagtgtgagggaaatcacagatgttctagatgctgtgggcaacacaactaaagctactacgaaaggatttgccatagg

SEQ ID NO: 427 - DNA, 277 bp, Zea mays
atcacccatggccgttggcgttgtcttccggattttgggccactacactggtcagcctcttcttggagctaaagttgtagcctccatgctgatgtttgcgacggtcgctgggattctcatggcactcttgcttgaacactgctggcggcgcctgggataatgcaaagaagtacattgagactggcgctcttggtggcaagggcagcgagtcccacaaggctgcggttactggcgacacggttggagacccattcaaagacactgctggaccgtcgct

SEQ ID NO: 428 - DNA, 265 bp, Zea mays
ttttgtttcaattgtcaggtggttgagattcctagaggcagcaaggttaagtacgagttggacaaggcatctggtctgatcaaggtggaccgtgttctttattcctctgttgtttacccacataactatggcttcattccacgcacactctgtgaggataacgaccccctggatgtcctcatactgatgcaggaacaagttgtccctgggtgtttcctgcgagctcgtgctattgggctcatgcctatgatcgatcagggcgaga

SEQ ID NO: 429 - DNA, 302 bp, Zea mays
cacactgatccggcctggagcgctggacagcagcagcagcatcgagctcgaggccgctccgccaccccgcactcgcctgtcgcctcttctcgctttcgccaccggggcagcgctccgccatggctggacctgctgttctcaatgagcgtatcctttcttccatgtcccagaaacatgttgctgctcacccatggcatgatttggagataggaccaggggctcctgaattcttcaattgtgtggttgagattcctagaggcagcaaggttaagtacgagttggacaaggcatctggtctgatc

SEQ ID NO: 430 - DNA, 287 bp, Zea mays
gctcgaggccgctcgccaccccgcactcgcctgtagcctcttctcgctttcgccaccggggcagcgctccgccatggctggacctgctgttctcaatgagcgtatcctttcttccatgtctcagaaacatgttgctgctcacccatggcatgatttggagataggaccaggggctcctgaattcttcaattgtgtggttgagattcctagaggcagcaaggttaagtacgagttggacaaggcatcttgtctgatccaggtcgacgtgttctttattcctctggtgg

SEQ ID NO: 431 - DNA, 266 bp, Zea mays
cccacgcgtccgcacactgatccggcctggagcgctggacagcagcagcagcagcagcatcgagctcgaggccgctccgccaccccgcactcgcctgtcgcctcttctcgctttcgccaccggggcagcgctccgccatggctggacctgctgttctcaatgagcgtatcctttcttccatgtcccagaaacatgttgctgctcacccatggcatgatttggagataggaccaggggctcctgaattcttcaattgtgtggttgag

SEQ ID NO: 432 - DNA, 239 bp, Zea mays
cccacgcgtccgatcacactgatccggcctggagcgctggacagcagcagcagcagcagcatcgagctcgaggccgctccgccaccccgcactcgcctgtcgcctcttctcgctttcgccaccggggcagcgctccgccatggctggacctgctgttctcaatgagcgtatcctttcttccatgtcccagaaacatgttgctgctcacccatggcatgatttggagataggaccagggg

SEQ ID NO: 433 - DNA, 211 bp, Zea mays
tgatccggcctggagcgctggacagcagcagcagcatcgagctcgaggccgctccgccaccccgcactcgcctgtcgcctcttctcgctttcgccaccggggcagcgctccgccatggctggacctgctgttctcaatgagcgtatcctttcttccatgtcccagaaacatgttgctgctcacccatggcatgatttggagataggaccag

SEQ ID NO: 434 - DNA, 260 bp, Zea mays
gacagcagcagcagcagcagcatcgagctcgaggccgctccgccaccccgcactcgcctgtcgcctcttctagctttcgccaccggggcagcgctccgccatggctggacctgctgttctcaatgagcgtatcctttcttccatgtcccagaaacatgttgctgctcacccatggcatgatttggagataggtggttgagattcctagaggcagcaaggttaagtacgagttggacaaggcatctggtctgatcaaggtg

SEQ ID NO: 435 - DNA, 376 bp, Zea mays
  unsure (1)..(376): unsure at all n locations
gctctcncctcaccgcctccaggagatccgccgcttcttcgaagactacaagaagaacgagaacaaggaggtggccgtcaacgacttcctgcccgccgccgctgcccgcgaaccatccagtactccatggacctgtacggccagtacatcatgcagaccctgcggcggtagagcgtgtcctaccagatcccatgcgagctgagctgacgcaagagcacagatcgacagaatccttgtggtctcgtctcatgcatggatagccaggtcacatggcttgtcgacgaccatgcatctcttcttcccagcgattttagcctgtatcttcccttatttatagtcttttggggttggtggaatctgtccacagtgtggtttg

SEQ ID NO: 436 - DNA, 268 bp, Zea mays
cccacgcgtccggcaggaacaagttgtccctgggtgttttctgcgagctcgtgctattgggctcatgcctatgatcgatcagggtgagaaagatgataagatcatagctgtctgtgctgatgaccctgaattccgtcactacaaggacatctcggacctccccccgcatcgccttcaagagatccgccgcttttttgaagattataaaaagaatgaaaacaaagaagttgcagtgaatgatttcctcccagccgaagatgccatcaaa

SEQ ID NO: 437 - DNA, 248 bp, Zea mays
agatgataagattatagcagtctgtgctgatgaccctgaattccgtcactacacggacatcacggacctcccaccgcatcgccttcaagagatccgccgcttttttgaagattataaaaagaacgaaaacaaggaggtcgcagtgaatgagttcctgccagcgaaagatgccatcaacgcaatcaagtactcgatggacctgtatggctcatacgtcatcgaaagcctgaggaagtgatctccagctg

SEQ ID NO: 438 - DNA, 274 bp, Zea mays
gagataccaaggggcagcaaggttaaatatgaacttgacaagaaaactggactgatcaaggtggaccgtgtgctgtattcatcagttgtttaccctcacaactatggattcattcctcgcacgctttgtgaagacagtgatcctttggatgtactggttataatgcaggagcctgttatcccaggctgtttcctacgtgcgaaggccatcggccttatgccgatgattgatcagggagaggcagatgacaagatcattgcagtgtgcgctgatg

SEQ ID NO: 439 - DNA, 292 bp, Zea mays
caaggttaaatatgaacttgacaagaaaactggactgatcaaggtggaccgtgtgctgtattcatcagttgtttaccctcacaactatggattcattcctcgcacgctttgtgaagacagtgatcctttggatgtactggttataatgcaggagcctgttatcccaggctgtttcctacgtgcgaaggccatcggccttatgccgatgattgatcagggagaggcagatgacaagatcattgcagtgtgcgctgatgatcccgagtacaggcattacaatgatatcaaggag

SEQ ID NO: 440 - DNA, 321 bp, Zea mays
ggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagctaggttaaatatgaacttgacaagaaaactggactgatcaaggtggaccgtgtgctgtattcatcagttgtttaccctcacaactatggattcattcctcgcacgctttgtgaagacagtgatcctttggatgtactggt

SEQ ID NO: 441 - DNA, 276 bp, Zea mays
cacacccttggcatgatctggagataggtcctggtgctccaaccatattcaactgcgtcattgagataccaaggggcagcaaggttaaatatgaacttgacaagaaaactggactgatcaaggtggaccgtgtgctgtattcatcagttgtttaccctcacaactatggattcattcctcgcacgctttgtgaagacagtgatcctttggatgtactggttataatgcaggagcctgttatcccaggctgtttcctacgtgcgaaggccatcggcc

SEQ ID NO: 442 - DNA, 272 bp, Zea mays
ctggactgatcaaggtggaccgtgtgctgtattcatcagttgtttaccctcacaactatggattcattcctcgcacgctttgtgaagacagtgatcctttggatgtactggttataatgcaggagcctgttatcccaggctgtttcctacgtgcgaaggccatcggccttatgccgatgattgatcagggagaggcagatgacaagatcattgcagtgtgcgctgatgatcccgagtacaggcattacaatgatatcaaggagctcccacct

SEQ ID NO: 443 - DNA, 270 bp, Zea mays
  unsure (1)..(270): unsure at all n locations
gatgtactggttataatgcaggngcctgttatcccaggctgtttcctacgtgcgaaggccatcggccttatgccgatgattgatcagggagaggcagatgacaagatcattgcagtgtgcgctgatgatcccgagtacaggcattacaatgatatcaaggagctcccacctcaccgcttggctgaaatcaggcgcttcttcgaggactacaagaagaatgagaacaaggaggttgctgtgaatgactttctaccagcgagcgccgcttat

SEQ ID NO: 444 - DNA, 245 bp, Zea mays
gcacgagattcattcctcgcacgctttgtgaagacagtgatcctttggatgtactggttataatgcaggagcctgttatcccaggctgtttcctacgtgcgaaggccatcggccttatgccgatgattgatcagggagaggcagatgacaagatcattgcagtgtgcgctgatgatcccgagtacaggcattacaatgatatcaaggagctcccacctcaccgcttggctgaaatcaggcgcttc

SEQ ID NO: 445 - DNA, 306 bp, Zea mays
ccgtgtgctgtattcatcagttgtttaccctcacaactatggattcattcctcgcacgctttgtgaagacagtgatcctttggatgtactggttataatgcaggagcctgttatcccaggctgtttcctacgtgcgaaggccatcggccttatgccgatgattgatcagggagaggcagatgacaagatcattgcagtgtgcgctgatgatcccgagtacaggcattacaatgatatcaaggagctcccacctcaccgcttggctgaaatcaggcgcttcttcgaggactacaagaagaatgagaa

SEQ ID NO: 446 - DNA, 310 bp, Zea mays
  unsure (1)..(310): unsure at all n locations
caggctgtttcctacgtgcgaagccatcggcttatgccgatgattgatcagggagaggcagatgacaagatcattgcagtgtgcgctgatgatcccgagtacaggcattacaatgatatcaaggagctcccacctcaccgcttggctgaaatcaggcgcttcttcgaggactacaagaagaatgagaacaaggaggttgctgtgaatgactttctaccagcgagcgccgcttatgaagccatacagcactctatggacctgtatgctacatacatcgttgnaggcatgaggaggtaagattctgatggct

SEQ ID NO: 447 - DNA, 273 bp, Zea mays
gttccaaccatattcaactgcgtcattgagataccaaggggcagcaaggttagctatgaacttgacaagaaaactggactgatcaaggtggaccgtgtgctgtattcatcagttgtttaccctcacaactatggattcattcctcgcacgctttgtgaagacagtgatcctttggatgtactggttataatgcaggagcctgtcatcccaggctgtttcctacgtgcgaaggccatcggctttatgccgatgattgatcagggagaggcagat

SEQ ID NO: 448 - DNA, 310 bp, Zea mays
  unsure (1)..(310): unsure at all n locations
atgaactgtttgtgtcacccatgttcctctgctccttggcactttctgatgcatgctcaaatgcttaagaaagactcatagaagcgactcctattcctatgccaggtcattgagataccaaggggcagcaaggttaaatatgnacttgacaagaaaactggactgctcaaggtggaccgtgtgctgtattcatcagttgtttaccctcacaactatggattcattcctcgcacgctttgtgaagacagtgatcctttggatgtactggttataatgcaggagcctgttatcccaggctgtttcctacgtg

SEQ ID NO: 449 - DNA, 192 bp, Zea mays
gcatgatctggagataggtcctggtgctccaaccatattcaactgcgtcattgagataccaaggggcagcaaggttaaatatgaacttgacaagaaaactggactgatcaaggtggaccgtgtgctgtattcatcagttgtttaccctcacaactatggattcattcctcgcacgctttgtgaagacagtga

SEQ ID NO: 450 - DNA, 225 bp, Zea mays
gggtgatggtcccgagtgcgggcgttgcggtggtatcgaggggctcccgcctcgccgcttggctgagatcaggcgcttcttcgaggactgcgagaagaatgagagcgaggcggctgctgtgaatgactttctgccggcgagcgccgcttgtgaagccgtgcggcgctctgtgggcctgtgtgctgcgtgcgtcgttgagggcctgaggaggtaggattctgatgg

SEQ ID NO: 451 - DNA, 244 bp, Zea mays
cgccgctgacccaggttgtcttgatggcgcccgctgtagaagccgtgaaggagacaggcaccttccagaaggttcctgccttgaacgaaaggatactgtcagccatgtccaggaggtctgttgctgcacacccttggcatgatctggagataggtcctggtgctccaaccatattcaactgcgtcattgagataccaaggggctactaggttaaatatgaacttgacaagaaaactggactgat

SEQ ID NO: 452 - DNA, 311 bp, Zea mays
cggctccgtcgtcgcgtgccatcctagggtttctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagcaaggttaaatatgaacttgacaagaaaactggactg

SEQ ID NO: 453 - DNA, 301 bp, Zea mays
agctccgtcgtcgcgtgccatcctagggtttctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagcaaggttaaatatgaacttgacaagaaa

SEQ ID NO: 454 - DNA, 290 bp, Zea mays
ctgaaatcaggcgcttcttcgaggactacaagaagaatgagaacaaggaggttgctgtgaatgactttctaccagcgagcgccgcttatgaagccatacagcactctatggacctgtatgctacatacatcgttgagggcctgaggaggtaggattctgatggctaggaaaggtggggaggatgttgacgaaaaactgggagaccatttaccgcatggaacgagtaccgttattattttatttgtgtcgtgtatactgctagtagtgaaccctcaatcaaagaccgaaat

SEQ ID NO: 455 - DNA, 249 bp, Zea mays
ccagatttggccgccgccgccgctgacccaggttgtcttgatggcgcccgctgtagaagccgtgaaggagacaggcaccttccagaaggttcctgccttgaacgataggatactgtcatccatgtccaggaggtctgttgctgcacacccttggcatgatctggagataggtcctggtgctccaaccatattcaactgcgtcattgagataccaggggcagcaaggttagatatgaacttgacaagaaa

SEQ ID NO: 456 - DNA, 312 bp, Zea mays
ctgacgcgtgggcggacgcgtgggcggctccgtcgtcgcgtgccatcctagggtttctttccccgtcggcgcctccccagatttggccgccgccgccgctgacgcaggttgtcctatatggcgcccgctgtagaagccgtgaaggagacaggcaccttccagaaggttcctgccttgaacgaaaggatactgtcatccatgtccaggaggtctgttgctgcacacccttggcatggtctggagataggtcctggtgctccaaccatattcaactgcgtcattgagataccaaggggcagcaaggttaaatat

SEQ ID NO: 457 - DNA, 359 bp, Zea mays
  unsure (1)..(359): unsure at all n locations
aggaaatagaaagtctccctggactctaaaatcaatgcctgtgaacacatgaactgtttgtgtcacccatgttcctctgctccttggcactttctgatggatgctcaaatgcttaagaaagactcatagaagcgactcctattcctatgccaggtcattgagataccaaggggcagcaaggttaaatatggacttgcaagaaaactggactgatcaaggtggaccgtgtgctgtattcatcagttgtttaccctcacaactatggattcattcctcgcacgctttgtgaagacagtgatcctttggatgtactggttataatgcangagcctgttatcccaggctgtttcctacgtgcg

SEQ ID NO: 458 - DNA, 293 bp, Zea mays
gactagttctagatcccggctccgtcgtcgtcgtgccatcctagggtttctttccccgtcggcgcctccccagatttggccgccgccgccgctgacccaggttgtcttgatggcgcccggctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagc

SEQ ID NO: 459 - DNA, 290 bp, Zea mays
actagttctagatcccggctccgtcgtcgcgtgccatcctagggtttctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagc

SEQ ID NO: 460 - DNA, 277 bp, Zea mays
cggctcgagggctccgtcgtcgcgtgccatcctagggtttctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtaaggccaccctgtcat

SEQ ID NO: 461 - DNA, 265 bp, Zea mays
cggacgctgggcggctccgtcgtcgcgtgccatcctagggtttctttccccgtcggcgcctccccagattacgccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtc

SEQ ID NO: 462 - DNA, 183 bp, Zea mays
gctgaaatcaggcgcttctacgaggactacaagaagaatgagaacaaggaggttgctgtgaatgactttctaccagcgagcgccgctatgaagccatacagcactctatggacctgtatgctacatacatcgttgagggcctgaggaggtaggattctgatggctaggaaaggtggggaggat

SEQ ID NO: 463 - DNA, 291 bp, Zea mays
  unsure (1)..(291): unsure at all n locations
caatgattgatgagggagagcttgactggaaaattgtggccatttctttggatgacccgaaagcatctcttgtgaacgacgtggatgatgttgagaagcattttccggggacactgactgccatcagagactggttcagagactacaagatacctgatggaaagcctgccaacaaatttggtctcggcaacaagcccgcaagcaaggaatacgccctgaaggtcattcaagagaccaacgaatcatgggagaaattggtanagagaaatattcccgctggagagctctcgt

SEQ ID NO: 464 - DNA, 281 bp, Zea mays
ccgaaagcatctcttgtgaacgacgtggatgatgttgagaagcattttccggggacactgactgccatcagagactggttcagagactacaagatacctgatggaaagcctgccaacaaatttggtctcggcaacaagcccgcaagcaaggaatacgccctgaaggtcattcaagagaccaacgaatcatgggagaaattggtaaagagaaatattcccgctggagagctctcgttggcctgattttggcccatggaagccaccacattcttttgaactgc

SEQ ID NO: 465 - DNA, 269 bp, Zea mays
tgttgagaagcattttccggggacactgactgccatcagagactggttcagagactacaagatacctgatggaaagcctgccaacaaatttggtctcggcaacaagcccgcaagcaaggaatacgccctgaaggtcattcaagagaccaacgaatcatgggagaaattggtaaagagaaatattcccgctggagagctctcgttggcctgattttggcccatggaagccaccacattcttttgaactgctttcgtgagcatgtcgtttt

SEQ ID NO: 466 - DNA, 257 bp, Zea mays
gacccaacttctgcaaattctgaggttgaaggagcgtttggggataatgatcctgttgatgttgttgagatcggtgaaagacgtgccaatgtcggggatgttcttaaggttaagccattggcagctttagcaatgattgatgagggagcagcttgactggaaaattgtggccatttctttggatgacccgaaagcatctcttgtgaacgacgtagatgatgttcaacagcttttccggggacactactgccatcaga

SEQ ID NO: 467 - DNA, 325 bp, Zea mays
gtttgccgatcgagcccgggcgacgtgagatacgagcggcgtcgaccggcgccggcgagcctccgcagccgcagccgcccgatctgggttttctttcgtagcggtagcgcaagatgagccaggaccaggagaacggaggcaccaacgggcagcacgccgccgacgtcatggaggtggagccgaagcgccgggcgccgcggctgaacgagcgcatcctgtcgtcgctgtcgcggaggtccgtcgccgcgcacccctggcacgacctcgagatcggtcctgaagctccggccgtcttcaacgtcgtcgtggagatcaccaaggggag

SEQ ID NO: 468 - DNA, 227 bp, Zea mays
  unsure (1)..(227): unsure at all n locations
cgtagtntagcggaagatgagccaggaccaggagaacggaggcaccaacgggcagcacgccgccgacgtgatggaggtggagccgaagcgccgggcgccgcggctgaacgagcgcatcctgtcgtcgctgtcgcggaggtccgtcgccgcgcacccctggcacgacctcgagatcggtcctgaagctccggccgtcttcaacgtcgtcgtggagatcaccaagggga

SEQ ID NO: 469 - DNA, 462 bp, Zea mays
  unsure (1)..(462): unsure at all n locations
agttgtgtatgtcacggtctgatgcgcgccactctcacatgcctncgcctgtcaggcagcgccaccggctctgtttcgtcatggttatgacaaaagtggatgcagttctccgttgccgattctcggaatcggtttctcgattgatgcctgaaatttcatcatgattagcgtttatgggtgatttcaacgatgagggggttcccaagggctatgctttccctctcacgatgcctactgttactctgattgagtgaagatttgcaaccttcactcacaggtcagctgctgcacatccgtggcatttcgtgtagattgttccataagcgcctactgttttcaactgtgtagttgtcattatcaagagtagtacggttaagtatgagctacacacagacagtagacttaattgggctgatcacgttctctattcaaccattatttacccccaaagctacggtttca

SEQ ID NO: 470 - DNA, 408 bp, Zea mays
gggtggcgtacttcacgtcgcggtgcggtctacaattagagtcgagcacgcgtccgatcatagtccgtgtacgcgtccaatgacgtctcttgcacagcgcaccataactcagcatttactgaacatggactgcagctcccctcggaggcgtcctcgctggcatgagcgggagaggagctactggtactacatctaatagcatggactggtctggtgaatgtggaccgtctgctttaatcatcaattatttaagctcataactatggattcattcctcacacgctttgtgaacacagtgatcctttggatgtactggttataatgcaggagcctgttatcccaggctgtttcctatgtgcgattgcaatcggccttatcccgaatattgatcagggagaagcagatgac

SEQ ID NO: 471 - DNA, 424 bp, Zea mays
agcgtcaccgtcctggtgatcacgcccagatcaaatcctattcaaatttggagcgcaatatggctgaagagaagagccgtccgcggctgaacgagcggatcatgtcgtccctctcaaagcggtcggtcgctgcgcattcctggcatgaccttgagataggacctggagcccctgctgttttcaattgtgttgttgagatcacaaagggcagtaaagtgaaatatgagctagacaagaagaccggaatgatcaaggttgacagggtgctatactcatcagtggtctacccacacaactacggtttcattccacgaacattgtgtgaagacggagatccaatggatgtgctggtgttgatgcaggaaccggtgatacctggctgttttcttcgggcaagggccatcggccttatgcccatgattga

SEQ ID NO: 472 - DNA, 472 bp, Zea mays
  unsure (1)..(472): unsure at all n locations
agaaatggtgtnnncctaaatctcagcctgatnctttaccactccctccggnatccgggcaagcgccggatccacgcgtcccgtgactcgtggtcggtgccccgttgcgtctctgtaaaaccagacggcgaaccactgctgcggtccactgcatcccgggtccgtcttctcgtgccatgctacggttgctttctcccgtcggcgcctgcgcagatttggccgccgtcgccgctgacccaggctgtcttgatggcgcccgatgcagaagccgctaaggggacaggcaccgttccacaaaggtgctctgccattgaacgaaaggatactggcatgcatgtccaggaggtctgctgctggacacccttggcatgatctggagataggccctggagctccaaccatattcaactgcgtcattgagatacccaggggcagcaaggtttaatatgaacttgacaaggaaactggactg

SEQ ID NO: 473 - DNA, 239 bp, Zea mays
catgtacaccgtcttaagagagttaaatgttagtgcttgcctcctgttagattgaatgggcggtttaaccgagacattcagacaagaagaatgagaacaaggaggttgctgcgaatgactttctaccagcgagcgccgcttatgaagccatacagcactctatggacctgtatgctacatacatcgcttgagggcctgaagaggtaggattctgatggctaggaaaggtcgcgaggatg

SEQ ID NO: 474 - DNA, 429 bp, Zea mays
cccacgcgtccgccgaaactccgacagtccgaccacaagaaggatgagtgaagaggatgagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactggactgattaaggttgatcgagtcctgtactcatcagttgtataccctcacaattatggtttcgttccaaggactctttgtgaagacaatgacccaatggatgtgttagtcctgatgcaggagcctgttgttcctggttcgttcctgcgagcaagagcaatcggccttatgcc

SEQ ID NO: 475 - DNA, 399 bp, Zea mays
cggcccacctggaagccggagagaatcgagcatagccaccgatcgctcctctccactgggcagattccagttccactccgcctccgctgccggtcgccgactccgaaactccgacagtccgaccacaatgatccacatatagatgagtggagaggataaggctgctgcttctgctgagcagccgaagagggcccctaagctcaatgaaaggatcctctcttctctgtccaggaggtccgtagctgctcatacgtggcatgatcttgagatcggtcctgatgctcctgctgttttcaatgttgatgttgagatcacaaagggaagcaaagttaaatatgagctcgacaagaaaactggactgattaaggttgatcgagtcctgtactcatcagttgtata

SEQ ID NO: 476 - DNA, 390 bp, Zea mays
ccgcagtgcaggactgaggatgagtgaagaggataaggctgctgcttctgctgagcggcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagaaaactggactgattaaggttgatcgagtcctttactcatcagttgtataccctcacaattatggtttcattccaaggactctttgtgaagacaatgacccaatggatgtgttggtcctgatgcaggagcctgttgttcctggttcgttcctgagagctagagc

SEQ ID NO: 477 - DNA, 398 bp, Zea mays
  unsure (1)..(398): unsure at all n locations
cggacgcgtgggcggacgcgtgggcggacgcgtgggccgatcgctcctctccactgtccagattccagttccactccgcctccgctgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccgtggcatgatcttgagatcggtcctgatgctcctgctgttttcaatgttgttgttgagatcacaaagggaagcanagttaaatatgagcttgacaagaaaactggactgattaanggtgatcgagtcctatactcat

SEQ ID NO: 478 - DNA, 362 bp, Zea mays
gggaagcaaagttaaatatgagcttgacaagaaaactggactgattaaggttgatcgagtcctatactcatcagttgtataccctcacaattatggtttcgttccaaggactctttgtgaagacaatgacccattggatgtgttggtcctgatgcaggagcctgttattcctggttcgttcctgcgagcaagagcaatcggccttatgcccatgattgaccagggtgaaaaggatgacaagataatagcagtctgtgctgatgatcctgaatatcgtcactacaacgacatcagtgagctgtcttctcatcgcctgcaagagatcaagcggttctttgaagattattagaagaatgaagatt

SEQ ID NO: 479 - DNA, 410 bp, Zea mays
gacccaatggatgtgttggtcctgatgcaggagcctgttgttcctggttcgttcctgagagctagagcaattggccttatgcccatgattgaccagggtgaaaaggatgacaagataatagcagtatgtgctgacgatcctgaataccgtcactacaacgacatcagcgagctgtctcctcaccgcctgcaagagatcaagcgcttctttgaagattacaagaaaaacgagaacaaagaagtcgcagttgatgcattcttgcccgcgacaacagctcaagaagccattcagtactccatggacctgtatgcccagtatattttgcaaagcttgaggcagtagattgcaagcaacaatttatctatcatgcgtcttggatcggggcgtgattttaataagccgaatcgctt

SEQ ID NO: 480 - DNA, 373 bp, Zea mays
gctcctctccactttccacattccagttccactccgactgcgctgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttggtgttgagatcacacagggatgcaaagcttaatatgaacttgacaagaaaaccggactgattaagggtgatcgagtcctggacttatcagttgtatacccttac

SEQ ID NO: 481 - DNA, 428 bp, Zea mays
cccactctccgaaggactctttgtgaatacaatgacccaatggatgtgttggtcctgatgcatgagcctgttgttcctggttcgttcctgagagctagagcaattggccttatgcccatgattgaccagggtgaaaaggatgacaagataatagcagtatgtgctgactatcctgaataccgtcactacaacgacatcagcgagctgtctcctcaccgcctgcaagagatcaagcgcttctttgaagattacaagaaaaacgagaacaaagaagtcgcagttgatgcattcttgcccgcgacaacagctcaagaagccattcagtactccatggacctgtatgcccagtatattttgcaaagcttgaagcagtagattgcaagcaacaatttatctatcatgcgtcttggatcggggcgtgattttaa

SEQ ID NO: 482 - DNA, 384 bp, Zea mays
aggtcaatacaacgacatcagcgagctgtctcctcaccgcctgcaagagatcaagcgcttctttgaagattacaagaaaaacgagaacaaagaagtcgcagttgatgcattcttgcccgcgacaacagctcaagaagccattcagtactccatggacctgtatgcccagtatattttgcaaagcttgaggcagtagattgcaagcaacaatttatctatcatgcgtcttggatgggggcgtgattttaataagccaaatcgcttgctatattgggaaccttggaattgagaacagcgtcactagctgtgattcgctcctttctcgttaaattatcatatgaataggccaagtccatacgtttaccgtgtggcgctctgtcagtc

SEQ ID NO: 483 - DNA, 435 bp, Zea mays
ggtttgcaggcgttgtcttccggattttggtccactacactggtcagcctcttcttggagctaaagttgtagcctccatgctgatgtttgcgacggtcgctgggattctcatggcactcttcttgaacactgctggcggcgcctgggataatgcacagaagtacattgagactggcgctcttggtggcaagggcagcgagtcccacaaggctgcggttactggcgacacggttggagacccattcaaagacactgctggaccgtcgctgcatgttcttatcaagatgctcgccacaatcacgctggtcatggctccgatattcttgtgattaaccaaccactcatcaagcttgctattaaccctgcggagatgtacctatgcgaccaggtagatgaggtgtgtgtgtgtgtgtgttacctgcatgtgatgatgta

SEQ ID NO: 484 - DNA, 322 bp, Zea mays
cggacgcgtgcgctcacgtggttgagtctcctatttgcagcaaggttaagtacgacggcgacagggcatctggtctgatcaaggtggaccgtgttctttattcctctgttgtttacccacataactatggcttcattccactgcacactctgtgaggataacgaccccctggatgtcctcatactgatgcaggaacaagttgtccctgtgtgattcctgcgagctcgtgctattgggctcatgcctatgatcgatcaggtctagtgtcttcgtcacctgatcgcatagtgcttgctatgtttaccttaggccatatattttt

SEQ ID NO: 485 - DNA, 441 bp, Zea mays
  unsure (1)..(441): unsure at all n locations
gggacaacgccaagaagtacattgaggctggagtttcagagcatgccaagacccttggcccaaaagggtctgaccctcacaaggcggctgtcattggtgacaccattggagatccctctaaggacacgtctggccctttcctcaacatcctcatcaagcttatggcggttgaatcccttgtcttcgcccncttcttcngccgccatggtggcattctcttcaaatggctctaagccagcgagagacgcangataaaagccgtagttttgcaaggcgagtagagcagtatgtcagtaatacagcatctatggcatgtgcttttgctcgtccagttcatgagccccgttgtgtatttggtttccgttttcttggttggagtttttagttccaaagtccgatcatgttttgatcccataaattctcttccagccttcgagcaac

SEQ ID NO: 486 - DNA, 468 bp, Zea mays
atcgccgtgtgcgccgacgaccccgagtaccgtcactacaacgacatcagcgagctctgccctcaccgcctacaggagatccgccgcttcttcgaagactacaagaagaacgagaacaaggaggtggccgtcaacgacttcctgcccgccgccgctgcccgcgaagccatccagtactgcatggacctgtacgggcagtacatcatgcagaccctgcggcggtagagcgtgtcctaccagatcccatgcgagctgagctgacgcaagagcacagatcgacagaatccttgtggtctagtctcatgcatggatagccaggtcacatggcttgtcgacgaccatgcatctgttcttcccagcgattctagcctgtatctgcccttatttatagtctcttgggtttggtggaatctgtccacagtgtggcttgatctatgtactactcttctacatttctaccagaacgaa

SEQ ID NO: 487 - DNA, 481 bp, Zea mays
gcctggcgcagcgtcagttgccagcacggtctagcaatccggtcggccacgcgtccgaggaaacgtgggcggacgcgtgggcacgcacactctgtgaggataacgaccccctgaatgtcctcatactgatgcaggaacaagttgtccctgggtgtttcctgcaagctcgtgctattgggctcatgcctatgatcgatcagggcgagaaagatgataagattatagcagtctgtgctgatgaccctgaattccgtcactacacggacatcacggacctcccaccgcatcgccttcaagagatccgccgcttttttgaagattataaaaagaacgaaaataaggaggtcgcagtgaatgagttcctgccagcgaaagatgccatcaacgcaatcaagtactcgatggacctgtatggctcatacgtcatcgaaagcctgaggaagtgatctccagctgcttgattgtggttgtggatgctaca

SEQ ID NO: 488 - DNA, 416 bp, Zea mays
cccacgcgtccgcatccatgtccaggaggtctgttgctgcacacccttggcatgatctggagataggtcctggtgctccaaccatattcaactgcgtcattgagataccaaggggcagcaaggttaaatatgaacttgacaagaaaactggactgatcaaggtggaccgtgtgctgtattcatcagttgtttaccctcacaactatggattcattcctcgcacgctttgtgaagacagtgatcctttggatgtactggttataatgcaggagcctgttatcccaggctgtttcctacgtgcgaaggccatcggccttatgccgatgattgatcagggagaggcagatgacaagatcattgcagtgtgcgctgatgatcccgagtacaggcattacaatgatatcaaggagctccca

SEQ ID NO: 489 - DNA, 400 bp, Zea mays
  unsure (1)..(400): unsure at all n locations
cccacgcgtccgtggattcattcctcgcactctttgtgaagacagtgatcctttggatgtactggttataatgcaggagcctgttatcccaggctgtttcctacgtgcgaaggctatcggccttatgccgatgattgatcagggagaggcagatgacaagatcattgcagtgtgcgctgatgatcccgagtacaggcattacaatgatatcaaggagctcccacctcaccgcttggctgaaatcaggcgcttcttcgaggactacaagaagaatgagaacaaggaggttgctgtgaacgactntctaccagcgagcgccgcttatgaagccatacagcactctatggatctgtatgctacatacatcngtgagggcctgangaggtaagattctgatggc

SEQ ID NO: 490 - DNA, 457 bp, Zea mays
  unsure (1)..(457): unsure at all n locations
acgctttccccgtcggcgcctactcagatttaattcggacgccgccgccgccgctgacccagggggtcttgatggcgcccgctgtagaagccgttaaggagacaggctcgttccagaaggttcctgccttgaacgaaaggatactgtcatccatgtccaggaggtctgttgctgcacacccttggcatgatctggagataggtcctggtgctccaaccatattcaactgcgtcattgagataccaaggggcagcaaggttaaatatgaacttgacaagaaaactggactgatcaaggtggaccgtgtgctgtattcgtcagttgtttaccctcacaactatggattcattcctagcactctctgtgaagacagtgatcctttggatgtactggttataatgcatgagcctgttatcccatgctgnttcctacgtgcgaaggctatcggccttatgcc

SEQ ID NO: 491 - DNA, 445 bp, Zea mays
cactgatcaactgcaacgcaatgacgagactcatgggtcgacgcaagactctagagtgaatgctatcagccttatgccgatgattgatcagggagaggcagatgacaagatcattgcagtgtgcgctgatgatcccgagtacaggcattacaatgatatcaaggagctcccacctcaccgcttggctgaaatcaggcgcttcttcgaggactacaagaagaatgagaacaaggaggttgctgtgaatgactttctaccagcgagcgccgcttatgaagccatacagcactctatggacctgtatgctacatacatcgttgagggcctgaggaggtatgattctgatggctaggaaaggtggggaggatgttgacgaaaaactgggagaccatttaccgcatggaacgagtaccgttattattttatttgtgtcgtgtatactgct

SEQ ID NO: 492 - DNA, 411 bp, Zea mays
acgctttccccgtcggcgcctcctcagatttaatttggacgccgtcggcgccgctgacccaggtggtcttgatggcgcccgctgtagaagccgtgaaggagacaggctcgttccatatggttcctgccttgaacgaaaggatactgtcatccatgtccaggaggtctgatgctgcacacccttggcatgatctggagatagcgtcctggtgcttcaaccatattcaactgcgtcattgagataccaaggggcagcaaggttaaatatgaacttgacaagaaaactggactgatcaaggtggaccgtgtgctgtattcgacagttgtttaccctgacaactatggattcattcctcgcactctttgcgaagacagtgatccttttgatgtactgggtattattcaagaacct

SEQ ID NO: 493 - DNA, 423 bp, Zea mays
atcaggcgcttcttgtagtcctcgaagaagcgcctgatttcagccaagcggtgaggtgggagctccttgatatgattgtaatgcctgtactcgggatcatcagcgcacactgcaatgatcttgtcatctgcctctccctgatcaatcatcggcataaggccgatagccttcgcacgtaggaaacagcctgggataacaggctcctgcattataaccagtacatccaaaggatcactgtcttcacaaagagtgcgaggaatgagaacaaggaggttgctgtgaacgactttctaccagcgagcgccgcttatgaagccatacagcactctatggatctgtatgctacatacatcgttgagggcctgaggaggtaggattctgatggctaggaaagtggggaggatgttgacgaaaaactgggag

SEQ ID NO: 494 - DNA, 340 bp, Zea mays
acgcggacgcgtgggcggacgcgtgggcggacgcgtgggctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagcaaggttaaatatgaacttgacaagaaaactggactgattcaaggtggacgtgtgctgt

SEQ ID NO: 495 - DNA, 438 bp, Zea mays
  unsure (1)..(438): unsure at all n locations
ctgggaacgttacccagcggtcaccgtgctagcatncgggtaccaccacgcgtccgcagacgcgtggacgcgtgccatcctagggtttctttccccgtcggcgcctcnccagatttggccgccgccgccgctgacccaggttgtcttgatggcgcccgctgtagaagccgtgaaggagacaggcaccttccagaaagttcctgccttgaacgaaaggatactgtcatccatgtccaggaggtctgttgctgcacacccttggcatgatctggagataggtcctggtgctccaaccatattcaactgcgtcattgagataccaaggggcagcaagggtataatatgaacttggaggggaagactggactgattcaagtggaccgtgtgctgtattcaacagttgtttaccctcacaacaatggattcattcctcgcacg

SEQ ID NO: 496 - DNA, 419 bp, Zea mays
ggccatttctttggatgacccgaaagcatctcttgtgaacgacgtggatgatgttgagaagcattttccggggacactgactgccatcagagactggttcagagactacaagatacctgatggaaagcctgccaacaaatttggtctcggcaacaagcccgcaagcaaggaatacgccctgaaggtcattcaagagaccaacgaatcatgggagaaattggtaaagagaaatattcccgctggagagctctcgttggcctgattttggcccatggaagccaccacattcttttgaactgctttcgtgagcatgtcgttttgtatgctgtgaccatgcttcttcgtttgcattccaaaccttttttacgaactgtttaacaaaaatgatcttgtcggataaataatgattctggtgcgag

SEQ ID NO: 497 - DNA, 428 bp, Zea mays
cacacgcgtccggggaggacccaacttctgcaaattctgaggttgaaggagcatttggggataatgatcctgttgatgttgttgagataggtgaaagacgtgccaatgtcggggacgttcttaaggttaagccattggcagctttagcaatgattgatgagggagagcttgactggaaaattgtggccatttctttggatgacccgaaagcatctcttgtgaacgacgtggatgatgttgagaagcattttccggggacactgactgccatcagagactggttcagagactacaagatacctgatggaaagcctgccaacaaatttggtctcggcaacaagcccgcaagcaaggaatacgccctgaaggtcattcaagagaccaacgaatcatgggagaaattggtaaagagaaatattcccgctgga

SEQ ID NO: 498 - DNA, 313 bp, Zea mays
ccaaggagctcgcgggaggcctgcagcagcggcgggccctgtaccagccccgcctcccgccatgcctccagggaccgacggtaagggcggagtacggtgacgcgaccacaaccatcgatcccacctgtgcccaagccgtcgcgcaggccttcccgcacacctttggccagccgctcgtcatcttcgtcgcgccggccgccggcgccggcgccgttagaggagcgccacccgatcagggtgggcgtggtgttctctgggaggcagtcgccgggatggcacaacgtcgtctggggcctccatgacgcacttaaag

SEQ ID NO: 499 - DNA, 256 bp, Zea mays
cccacgcgtccggatcagaggaggcatccgtgaccaaagatcgagtagccaagaagaagagagatgaacgccgacttcggcgcgcccaaggagctcgcgggaggcctgcagcagcggcgggccctctaccagccccgcctcccgccatgcctccagggaccgacggtaagggcggagtacggtgacgcgaccacaaccatagatcccacctgtgcccaagccgtcgcgcaggccttcccgcacacctttggccagc

SEQ ID NO: 500 - DNA, 277 bp, Zea mays
cccacgcgtccggaacagacgtttgaaggagggcacttacaaaggaaagaaagttaatgcaatctgtcacttctttggctaccaagctaggggagcactgccttccaagtttgactgcgattatgcctatgtcttggggcatgtgtgctaccacatcatagctgccggtttgaacggttacatgggcacagtgacaaatgttaagagtccagtgaacaagtggcgatgtggtgcggctcctatttcgtctatgatgactgtgcagcgatggtcgcgt

SEQ ID NO: 501 - DNA, 132 bp, Zea mays
cgagacgcgtgggagagcaggtcaatggtgctatggctagttgccaagctttgaagttggatgctctggttatcactggaggtgtcacttccaacactgatgctgctcaacttgccgagacatttgctgagg

SEQ ID NO: 502 - DNA, 290 bp, Zea mays
cattgtgaagcctgggtgctctcaggatgtccttaaggcggcgctgagcgccatgtcttctgtgacggagacactgaacatcatgacctcatcgtccaccggccagactgcactgtgactcgtttggtgccgttttgtggtgcggatcagaatccccactttttccatggtgtcgattgacaaagttaggagcagtaatcctgtggtgccgatcagaatccccactttttccatggtgccacacgggtcattcttttgtagcttcttgggagagttctatcagttttgaa

SEQ ID NO: 503 - DNA, 290 bp, Zea mays
cattgtgaagcctgggtgctctcaggatgtccttaaggcggcgctgagcgccatgtcttctgtgacggagacactgaacatcatgacctcatcgtccaccggccagactgcactgtgactcgtttggtgccgttttgtggtgcggatcagatccccactttttccatggtgtcgattgacaaagttaggagcagtaatcctgtggtgcggatcagaatccccactttttccatggtgccacacgggtcattcttttgtagcttctcgggagagttctatcagttttgaat

SEQ ID NO: 504 - DNA, 275 bp, Zea mays
gcgccacccgcacccaccaacgaggcaacgaaacccagtcggaagctagaccggcgacaagtgcagcgctcgccgcgatggatactgactacggcgtgccgcgcgagctgtcggaggtgcagaagaagcgcgcgctctaccagcccgaggtgcccccctgcatccaggggactactgtcagggtggagtatggtgacgccgcaattgcagctgaccaggcaggcgctcatgtgatcagccatgcgttccctcacacctatgggcagccccttgca

SEQ ID NO: 505 - DNA, 255 bp, Zea mays
cagctttctcagattgaagaccagaagaactttctaccccagttagttgagactgaaatggacagacttttgaaggagggcacttacaaaggaaagaagtttaatgcaatctgtcacttctttggctaccaagctaggggagcactgccttccaagtttgactgcgattatgcctatgtcttggggcatgtgtgctaccacatcatagctgccggtttgaacggttacatggccacagtgacaaatgttaagagt

SEQ ID NO: 506 - DNA, 421 bp, Zea mays
ctttttgttggaagatgtctacaggaacccaagcccggttcagtttgaagggccaagtgcccattcaaagcctatgtgagttgtccttgaaggttcagaactttttggccggattaaaaaagttcaggattccttggaaaaggtgaaaaggattgtgaaccctgggtgctcgcaggatgttcttaaagcggcgctgagtgccatgtcttctgtgacggaaacactgaacatcatgacttcatcttctaccggccagactccactgagtcattaggtaccatttcatggtatggatcataatccccacttttttcagtggtggcgattaacgagtttaggaacagcaaccctggtatcatacgggttattctttttgtagccttttggagagttctatcggttttggattcggtagtttatg

SEQ ID NO: 507 - DNA, 363 bp, Zea mays
gcattgtgaagcccgggtgctcgcaggatgtccttaaagcagcggtaagcgccatggcttctgtgacggagatgttgaccatcatgtcttccctttcatttagtggacaggcgaccatctgaaggccaagctgaagatgtcatatgctgttgcgctgtcatgtcccgaacatatttgtgtttttttgggaaagaaacatacaattttttgttctcattctagtatcgtctacctatgtcaaactacaatatgataggacccttgcgaaataattgtttcgtttgctggtatttctcatctttgatgctaaaaaaaaaggacatattgtgtaagaaagttcaagggtgcacatcacaccaatat

SEQ ID NO: 508 - DNA, 171 bp, Zea mays
cccacgcgtccgcgcatgtggaacctctcctctggttgggggcaattcatggcggtcacgacgagagcttacagatccgaatgggcccgtgtactacaacggcatgtaccacctgttctaccagtacaacccgcacggggcgctctgggacgtgggcaacctctcatgggg

SEQ ID NO: 509 - DNA, 142 bp, Zea mays
  unsure (1)..(142): unsure at all n locations
gtgnnccanccggtcggacgagggctgaacccaggnccagttcagagacccgacgaccggctggatcggcccggacggnttgtggangatagccgtcggggccgaggtcgacggccacagcncggngcttctgtacganagc

SEQ ID NO: 510 - DNA, 288 bp, Zea mays
gctcctccatggccatggccatggcccgaccttgtgctttccttctcttcttcctagttcttttctcctacgacggatccggtcctgcgagcagcaggaggactaggaggagtggcgtcgcgcaggccacgcagagagtcttcctgtatccacaggctcccaaggtctcctccatcgtgagcagcaagtacaggaccgcgtaccacttccagcctcccaagaactggatcaacgatccaaatggaccaatgtactacaatggtatctaccaccagttctaccagtaca

SEQ ID NO: 511 - DNA, 241 bp, Zea mays
aaagaatcaagctgcagggtctgaacgtgacaccaaagattcttgtgctgactaggctgataccagatgccaagggtacaaaatgcaatgtggagctcgagccagttgaaaatacaaaacattcccacatacttcgtgtgccattcaagactgaaaacggcaaggagttgcgccagtgggtgtcccggtttgacatctacccttacctagagagatatgcccaggattcttgtgccaaaat

SEQ ID NO: 512 - DNA, 185 bp, Zea mays
  unsure (1)..(185): unsure at all n locations
ctcgtgaccaaagggtaatctgaaccatcgagccantgccgccaagcagacncgtctccacagtcngcgcgtacgtcttngngccacctnctcctctcatcccaatgaactgatagcactctagtccaggtatgtccaccatggcaattgaatgcgtcagcgccatcagctgctttcggagtatg

SEQ ID NO: 513 - DNA, 285 bp, Zea mays
ggaagagatcgcggagatagagaagatgcatgaactcatcaagacccacaacttgttcgggcagttccgctggatctctgcccagacaaacagggcccgtaacggcgagctctatcgctacatcgctgatacccatggtgctttcgtacagccggccttctatgaagcgttcggtctcaccgtcgttgaagccatgacctgtggacttcctactttcgcgacgctccatggagggccagctgagatcatagagcatggcgtctcgggcttccacattgacccgta

SEQ ID NO: 514 - DNA, 112 bp, Zea mays
gtccatttgatttgcgttcactgcgttgcgtttccttggaggggattgttctctcctctccatgggattggaggtccctccttcttctcctctctctctcagatgaacgcct

SEQ ID NO: 515 - DNA, 135 bp, Zea mays
gctccaggggagacaatgttgaacttgggatcgaaaaccgacaagagactcactgctcatccagatcgagagtcatctaaggacgtcagactcgcacactcggctagacagaaagcgtcactccgaggggccacg

SEQ ID NO: 516 - DNA, 297 bp, Zea mays
ataagaaatggatatcaagatttgatgtgtggccatatctggaaacatttgctgaggatgctgctggtgaaattgctgctgaattacaaggtactccagacttcataattggaaactacagtgatggaaatcttgtggcatcgttgctatcttacaagatgggaattacccagtgcaacattgctcatgctctggaaaagactaagtatccagattcagacatattttggaagaatttcgatgagaagtaccatttctccttcagttcacggctgatataattgctatgaacaatgc

SEQ ID NO: 517 - DNA, 202 bp, Zea mays
tagcactcgtttccaggtatgttcaccagggcaagggaatgcttcatcgccatcagctgcttgcggagtttgatgccctgtttggatagtgacaaggagaagtatgcaccctttgaagacattcttcgtgctgctcaggaagcaattgtgctccccccatgggttgcacttgctatggggccaagtccggttgtctgggatt

SEQ ID NO: 518 - DNA, 346 bp, Zea mays
tcgtatcccacatggatacattggacaaggtaatgtattaggcttgccagacacacagaggatagatcgtctatatactggaccaagttcgtgcactagtaaatgggatcgctctacgtttacagccacaagggcttgatgtttccccaaagattcacattgctagtcggctgatcatagatggagtaggtagatcatgcaatcagcgggttgagagagttagtggcacacagcatacttacatattacgagttcacttctgagatgaaaatgggatacttatgaagtggatatcaagattatgatgagaggcgatatctggagacatttgctgaggatgctgctg

SEQ ID NO: 519 - DNA, 62 bp, Zea mays
ccgttctacgacacgttcggcctgctgtgtcgagtcatacgtcggctgcaagatcggctgca

SEQ ID NO: 520 - DNA, 250 bp, Zea mays
ggacaccgtggggcagtacgagtcccacatcgcgttcactcttcctgggctctaccgtgtccttgcttcccgcgatttcttggaatgtgctggtgatgatgaaatcggtgtggttcatggcaataaggtcagctgtgaactggcaagagaagtggtactggctgtacgagtcccacatcgcgttcactcttcctgggctctaccgtgtcgtccatggcatcgatgttttcgatcccaagttcaacattgt

SEQ ID NO: 521 - DNA, 142 bp, Zea mays
catttccgatggacttcgacatggagtgcaattccttgtcctggaacaacttggacgaggagagtttgtaccccttgctgaacttcctcaaggctcataactacaagggcacgacgatgatgttgaatgacagaatccaaag

SEQ ID NO: 522 - DNA, 264 bp, Zea mays
actttcgcgacgctccatggagggccagctgagatcatagagcatggcgtctcgggcttccacattgacccgtaccaccccgagcaggctgctaatctgatggccgacttcttcgagcggtgcaagcaagacccagatcactgggtgaaaatatctggagcagggctgcagcgcatatacgagaagtacacatggaagatctactcagagaggttgatgacactggccggggtctacggtttctggaagtacgtgtcgaagctc

SEQ ID NO: 523 - DNA, 310 bp, Zea mays
  unsure (1)..(310): unsure at all n locations
cagtgatggaaatcttgtggcatcgttgctatcttacaagatgggaattacccagtgcaacattgctcatgctctggaaaagactanatatccagattcagacatattttggaagaacttcgatgagaagtaccatttctcctgtcagttcactgctgatataattgctatgaacaatgctgattttatcatcaccagcacataccaagaaattgctggaagcaaaaatactgttggacagtatgagagtcatactgcttttactctgcctggtctgtaccgagttgtccatgggatcgatgtcttcgat

SEQ ID NO: 524 - DNA, 181 bp, Zea mays
atgaacaatgctgattttatcatcaccagcacataccaagaaattgctggaagcaaaaatactgttggacagtatgagagtcatactgcttttactctgcctggtctgtaccgagttgtccatgggatcgatgtcttcgatccaaagttcaatatagtctctcctggagctgacatgtcca

SEQ ID NO: 525 - DNA, 148 bp, Zea mays
cacataccaagaaattgctggaagcaaaaatactgttggacagtatgagagtcatactgcctttactctgcctggtctgtaccgagttgtccatgggattgatgtcttcgatccaaagttcaatatagtctctcctggagctgacatg

SEQ ID NO: 526 - DNA, 283 bp, Zea mays
ctcgagccccaaagttcaatatagtctctcctggagctgacatgtccatatactttccacataccgagaaggccaagcgactcacctctcttcatggttcaatcgaaaatttgatttatgacccggagcaaaacgatgaacacattgggcatctggatgaccggtcaaagcccatcctcttctccatggcaagactcgacagggtgaagaacataacggggctggtcgaagcttttgccaagtgcgctaagctgagggagctggtaaaccttgtcgtcgttgc

SEQ ID NO: 527 - DNA, 150 bp, Zea mays
accgagttgtccatgggatcgatgtcttcgatccaaagttcaatatagtctctcctggagctgacatgtccatatactttccacataccgagaaggccaagcgactcacctctcttcatggttcaatcgaaaatttgatttatgacccgg

SEQ ID NO: 528 - DNA, 255 bp, Zea mays
gttcctcaaccgacacttgtcctcaatcatgttccgcaacagggattgcttggacgccctgctggatttcctccgtggccaccggcacaaggggcatgttatgatgcttatgatagaatacaaagcttggggaggcttcagtctgtgctgaccaaagctgaggagcacttgtcaaagctccctgctgacacaccatactcacaatttgcttataaatttcaagagtggggcctggagaaaggtggggtgatacag

SEQ ID NO: 529 - DNA, 137 bp, Zea mays
ccgcaacacggattgcttggagcccctgttggatttcctccgtggccaccggcacaaggggcatgttatgatgcttaatgatagaatacaaaacttggggaggcttcagtctgtgctgaccaaagctgaggagcact

SEQ ID NO: 530 - DNA, 293 bp, Zea mays
cggacgcgtgggcaaggatggtgcttttgaggatgtcctgagggcagctcaggaggcgattgtcatcccccacatgggttgcacttgccatccgccctaggcctggtgtctgggagtatgtgagggtcaacgtcagtgagctcgctgttgaggagctgagagttcctgagtacctgcagttcaaggaacagcttgtggaagaaggccccaacaacaactttgttcttgagctggactttgagccattcaatgcctccttcccccgtccttctctgtcaaagtccattggcaat

SEQ ID NO: 531 - DNA, 308 bp, Zea mays
gatggtgcttttgaggatgtcctgagggcagctcaggaggcgattgtcatccccccatgggttgcacttgccatccgccctaggcctggtgtccgggagtatgtgaaggtcaacgtcagtgggctcgctgttgaggagctgagagttcctgagtacctgcagttcaaggaacagcttgtggaagaaggccccaacaacaactttgttcttgagctggactttgagccattcaatgcctccttcccccgtccttctctgtcaaagtccattggcaatggcgtgcagttcctcaacaggcacctgtcatc

SEQ ID NO: 532 - DNA, 170 bp, Zea mays
ggctttttggaggccgaggccattggtgccatgcggccagcccttttcttctccatggttcccatcgatgtgtttttgttcggttctctcgtcagatctgtataaataggcgcctcccttctccgccattcctcggtcctctgaagcgtttcagttcatcgattcagttc

SEQ ID NO: 533 - DNA, 303 bp, Zea mays
gctggtcgaagcttttgctaagtgcgctaagctgagggagctggtaaaccttgtcgtcgttgccgggtacaatgatgtcaacaagtccaaggacagggaagagatcgcggagatagagaagatgcatgaactcatcaagacccacaacttgttcgggcagttccgctggatctctgcccagacaaacagggcccgtaacggcgagctctatcgctacatcgctgatacccatggtgctttcgtacagccggccttctatgaagcgttcggtctcaccgtcgttgaggccatgacctgtggact

SEQ ID NO: 534 - DNA, 365 bp, Zea mays
caccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaccgcgtccgcaacggcgagctgt

SEQ ID NO: 535 - DNA, 330 bp, Zea mays
ataccttgttgcgtgtttgctcgcccacaagatgggtgttactcactgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgactccaagttcaacatcgtgtctcctggcgc

SEQ ID NO: 536 - DNA, 332 bp, Zea mays
gaagatcctcattgttaccaggctgttgcctgatgctgctgggactacgtgcggtcagcggctggagaaggtcattggtactgagcacacagacatcattcgcgttcccttcagaaatgagaatggcatcctccgcaagtggatctctcgttttgatgtctggccatacctggagacatacactgaggatgtttccagtgaaataatgaaagaaatgcaggccaagcctgaccttatcattggcaactacagcgatggcaacctagtcgccactctgctcgcgcacaagttgggagtcactcagtgtaccatcgctcatgccttggagaaaa

SEQ ID NO: 537 - DNA, 340 bp, Zea mays
tgcagcctgctttctacgaggctttcgggctgacggtggttgaggccatgacctgcggcctgcccacgttcgccaccgcctacggcgtccggccgagatcatcgtgcacggcgtgtctggctaccacatcgacccttaccagggcgacaaggcgtcggccctgctcgtggacttcttcgacaagtgccaggcggagcgatgccactggagcaagatctcccagggcgggctccagcgtatcgaggagaagtacacctggaagctgtactcggagaggctgatgaccctcaccggcgtgtacgggttctggaagtacgtgtccaacctggagaggcgcgag

SEQ ID NO: 538 - DNA, 322 bp, Zea mays
aggcactcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaccgcgtccgcaacggcgagctgta

SEQ ID NO: 539 - DNA, 337 bp, Zea mays
cggaccgtggccttcgcgtgccattcagaacagaaaacggaatcgttcgcaagtggatgtcgcgatttgaagtctggccgtacctggagacttacactgatgacgtggcgcatgagattgctggagagcttcaggccaatcctgacctgatcatcggaaactacagtgacggaaaccttgttgcgtgtttgctcgcccacaagatgggtgttactcactgtaccattgcccatgcgcttgagaaaactaagtaccctaactccgacctctactggaagaagtttgaggatcactaccacttctcgtgccagttcaccactgacttgattgcaatgaa

SEQ ID NO: 540 - DNA, 320 bp, Zea mays
gctaatgtcttgggttaccctgacaccggaggccaggttgtctacatcttggatcaagtgcgcgctatggagaacgaaatgctgctgaggatcaagcagtgtggtcttgacatcacgccgaagatccttattgtcaccaggttgctccctgatgcaactggcaccacctgtggccagcgccttgagaaggtccttggcaccgagcactgccatatccttcgcgtgccattcagaacagaaaacggaatcgttcgcaagtggatctcgcgatttgaagtctggccgtacctggagacttacactgatgacgtggcgcatga

SEQ ID NO: 541 - DNA, 315 bp, Zea mays
cgacagaatccgcagtctcagtgctctgcaaggtgcgctgaggaaggctgaggagcacctgtccaccctacaagctgataccccatactctgaatttcaccacaggttccaggaacttggtctggagaagggttggggtgattgcgctaagcgtgcacaggagactatccacctcctcttggacctcctggaggccccagatccgtccaccctggagaagttccttggaacgatccccatggtgttcaatgtcgttatcctctcccctcatggttacttcgctcaagctaatgtcttgggttaccctgacaccgg

SEQ ID NO: 542 - DNA, 327 bp, Zea mays
gcgcattcgtgcagcctgcgttctacgaagcgttcggcctgactgtgatcgagtccatgacgtgcggtctgccaacgatcgcgacctgccatggtggccctgctgagatcatcgtggacggggtatctggcctgcacattgacccttaccacagcgacaaggccgcggatatcctggtcaacttctttgacaaatgcaaggcagatccgagctactgggacaagatctcacagggcggcctgcagagaatctatgagaagtacacctggaagctctactccgagaggctgatgaccctgaccggcgtgtacgggttctggaagtacg

SEQ ID NO: 543 - DNA, 318 bp, Zea mays
gaatcgttcgcaagtggatctcgcgatttgaagtctggccgtacctggagacttacactgatgacgtggcgcatgagattgctggagagcttcaggccaatcctgacctgatcattggaaactacagtgacggaaaccttgttgcgtgtttgctcgcccacaagatgggtgttactcactgtaccattgcccatgcgcttgagaaaactaagtaccctaactccgacctctactggaagaagtttgaggatcactaccacttctcgtgccagttcaccactgacttgattgcaatgaaccatgccgacttcatcatca

SEQ ID NO: 544 - DNA, 317 bp, Zea mays
cttcatcatcaccagtaccttccaagagatcgccggaaacaacgacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtatagcccaaccgagaacacggagcacaagttcgttctgaacgacaggaacaagccaatcatcttctccatggctcgtctcg

SEQ ID NO: 545 - DNA, 322 bp, Zea mays
gctgaccttattgccatgaaccacaccgatttcatcatcaccagcacattccaagaaatcgcgggaagcaaggacaccgtggggcagtacgagtcccacattgcgttcactcttcctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgagaactccgagcacaagttcgtgctgaaggacaagaagaagccga

SEQ ID NO: 546 - DNA, 318 bp, Zea mays
ctcccctcatggttacttcgctcaagctaatgtcttgggttaccctgacaccggaggccaggttgtctacatcttggatcaagtgcgcgctatggagaacgaaatgctgctgaggatcaagcagtgtggtcttgacatcacgccgaagatccttattgtcaccaggttgctccctgatgcaactggcaccacctgtggccagcgccttgagaaggtccttggcaccgagcactgccatatccttcgcgtgccattcagaacagaaaacggaatcgttcgcaagtggatctcgcgatttgaagtctggccgtacctgga

SEQ ID NO: 547 - DNA, 318 bp, Zea mays
accgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatc

SEQ ID NO: 548 - DNA, 326 bp, Zea mays
ggagaagttccttggaactataccaatgatgttcaatgttgttatcctttctcctcatggctacttcgctcagtccaatgtgcttggataccctgacactggcggtcaggttgtgtacattctggatcaagtccgtgctttggagaatgagatgcttctgaggattaagcagcaaggccttgatatcactccgaagatcctcattgttaccaggctgttgcctgatgctgctgggactacgtgcggtcagcggctggagaaggtcattggtactgagcacacagacatcattcgcgttccgttcagaaatgagaatggcatcctcc

SEQ ID NO: 549 - DNA, 320 bp, Zea mays
accgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggc

SEQ ID NO: 550 - DNA, 330 bp, Zea mays
tctggccatacctggagacatacactgaggatgtttccagtgaaataatgaaagaaatgcaggccaagcctgaccttatcattggcaactacagcgatggcaacctagtcgctactctgctcgcgcacaagttgggagtcactcagtgtaccatcgctcatgccttggagaaaaccaaataccccaactcggacatatacttggacaaattcgacagccagtaccacttctcttgccagttcacagctgaccttattgccatgaaccacactgatttcatcatcaccagcacattccaagaaatcgcgggaagcaaggacaccgtggggc

SEQ ID NO: 551 - DNA, 318 bp, Zea mays
ctacagcgacgtcgagaactccgagcacaagttcgtgctgaaggacaagaagaagccgatcatcttctcgatggcgcgtctcgaccgcgtgaagaacatgacaggcctggtcgagatgtacggcaagaacgcgcgcctgagggagctggcgaacctcgtgatcgttgccggtgaccacggcaaggagtccaaggacagggaggagcaggcggagttcaagaagatgtacagcctcatcgacgagtacaagttgaagggccatatccggtggatctcggcgcagatgaaccgcgtccgcaacggggagctgtaccgcta

SEQ ID NO: 552 - DNA, 311 bp, Zea mays
aagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttca

SEQ ID NO: 553 - DNA, 320 bp, Zea mays
gttcctcaacaggcacctgtcatcaaagctcttccatgacaaggagagcatgtaccccttgctcaacttccttcgcgcccacaactacaaggggatgaccatgatgttgaacgacagaatccgcagtctcagtgctctgcaaggtgcgctgaggaaggctgaggagcacctgtccaccctacaagctgataccccatactctgaatttcaccacaggttccaggaacttggtctggagaagggttggggtgattgcgctaagcgtgcacaggagactatccacctcctcttggacctcctggaggccccagatccgtcca

SEQ ID NO: 554 - DNA, 311 bp, Zea mays
gacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgc

SEQ ID NO: 555 - DNA, 363 bp, Zea mays
tgtctggctaccacatcgacgcttaccagggcgacaaggcgtcggccctgctcgtggacttcttcgacaagtgacaggcggagcgagccactggagcaagatctcccagggcgggctccagcgtatcgaggagaagtacacctggaagctgtactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagcctccagcaagtgatgcgtgacggcggccacagacctgatcgatcgatgagcgaga

SEQ ID NO: 556 - DNA, 317 bp, Zea mays
cagaaaacggaatcgttcgcaagtggatctcgcgatttgaagtctggccgtacctggagacttacactgatgacgtggcgcatgagattgctggagagcttcaggccaatcctgacctgatcatcggaaactacagtgacggaaaccttgttgcgtgtttgctcgcccacaagatgggtgttactcactgtaccattgcccatgcgcttgaggaaactaagtaccctaactccgacctctactggaagaagtttgaggatcactaccacttctcgtgccagttcaccactgacttgattgccatgaaccatgccgac

SEQ ID NO: 557 - DNA, 310 bp, Zea mays
cccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgccca

SEQ ID NO: 558 - DNA, 311 bp, Zea mays
cttggtctggagaagggttggggtgattgcgctaagcgtgcacaggagactatccacctcctcttggacctcctggaggccccagatccgtccaccctggagaagttccttggaacgatccccatggtgttcaatgtcgttatcctctcccctcatggttacttcgctcaagctaatgtcttgggttaccctgacaccggaggccaggttgtctacatcttggatcaagtgcgcgctatggagaacgaaatgctgctgaggatcaagcagtgtggtcttgacatcacgccgaagatccttattgtcaccag

SEQ ID NO: 559 - DNA, 317 bp, Zea mays
cttgggttacctgacaccggaggccaggttgtctacatcttggatcaagtgcgcgctatggagaacgaaatgctgctgaaggatcaaagcagtgtgggtcttaacatcacgccgaagatccttattgtcaccaggttgctccctgatgcaactggcaccacctgtggccagcgccttgagaaggtccttggcaccgagcactgccatatccttcgcgtgccattcagaacagaaaacggaatcgttcgcaagtggatctcgcgatttgacatctggccgtacctggagacttacactgatgacgtggcgcatgagat

SEQ ID NO: 560 - DNA, 307 bp, Zea mays
cgagattgaggagctcctgtacagccaaaccgagaacacggagcacaagttcgttctgaacgacaggaccaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaac

SEQ ID NO: 561 - DNA, 307 bp, Zea mays
gtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagc

SEQ ID NO: 562 - DNA, 314 bp, Zea mays
cggacatctacttggacaagttcgacagccagtaccacttctcttgccagttcacagctgaccttattgccatgaaccacactgatttcatcatcaccagcacattccaagaaatcgcgggaagcaaggacaccgtggggcagtacgagtcccacatcgcgttcactcttcctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggag

SEQ ID NO: 563 - DNA, 305 bp, Zea mays
gagatgcttctgaggattaagcagcaaggccttgatatcactccgaagatcctcattgttaccaggctgttgcctgatgctgctgggactacgtgcggtcagcggctggagaaggtcattggtactgagcacacagacatcattcgcgttccgttcagaaatgagaatggcatcctccgcaagtggatctctcgttttgatgtctggccatacctggagacatacactgaggatgtttccagtgaaataatgaaagacatgcaggccaagcctgaccttatcattggcaactacagcgatggcaa

SEQ ID NO: 564 - DNA, 316 bp, Zea mays
gtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgtacgggttctggaagtacgtgtccaacctggagaggcgcgagacccggcggt

SEQ ID NO: 565 - DNA, 306 bp, Zea mays
atgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaacacggagcccaagttcgttctgaacgacaggaacaagccaatcatct

SEQ ID NO: 566 - DNA, 310 bp, Zea mays
gttcggcctgactgtgatcgagtccatgacgtgcggtctgccaacgatcgcgacctgccatggtggccctgctgagatcatcgtggacggggtatctggcctgcacattgacccttaccacagcgacaaggccgcggatatcctggtcaacttctttgacaaatgcaaggcagatccgagctactgggacaagatctcacagggcggcctgcagagaatttatgagaagtacacctggaagctctactccgagaggctgatgaccctgaccggcgtgtacgggttctggaagtacgtgagcaacctggag

SEQ ID NO: 567 - DNA, 320 bp, Zea mays
cccacgcgtccggcgatttgaagtctggccgtacctggagacttacactgatgacgtggcgcatgagattgctggagagcttcaggccaatcctgacctgatcatcggaaactacagtgacggaaaccttgttgcgtgtttgctcgcccacaagatgggtgttactcactgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtaccttcc

SEQ ID NO: 568 - DNA, 311 bp, Zea mays
ggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgttcgccaccgcctacggcgtccggccgagatcatcgtgcacggcgtgtctggctaccacatcgacccttaccagggcgacaaggcgtcggccctgctcgtggactt

SEQ ID NO: 569 - DNA, 313 bp, Zea mays
  unsure (1)..(313): unsure at all n locations
gtctgggagtatgtgagggtcaacgtcatgangctcgctgttgaggagctgagagttcctgagtacctgcagttcaaggaacagcttgtggaagaaggccccaacaacaactttgttcttgagctggactttgagccattcaatgcctccttcccccgtccttctctgtcaaagtccattggcaatggcgtgcagttcctcaacaggcacctgtcatcaaagctcttccatgacaaggagagcatgtaccccttgctcaacttccttcgcgcccacaactacaaggggatgaccatgatgttgaacgacagaa

SEQ ID NO: 570 - DNA, 309 bp, Zea mays
accaagggcgccttcgtgcagcctgctttctacgaggctttcgggctgacggtggttgacgccatgacctgcggcctgcccacgttcgccaccgcctacggcgtccggccgagatcatcgtgcacggcgtgtctggctaccacatcgacccttaccagggcgacaaggcgtcggccctgctcgtggacttcttcgacaagtgccaggcggacgatgccactggagcaagatctcccagggcgggctccagcgtatcgaggagaagtacacctggaagctgtactcggagaggctgatgaccctcaccgg

SEQ ID NO: 571 - DNA, 305 bp, Zea mays
aacttggtctggagaagggttggggtgattgcgctaagcgtgcacaggagactatccacctcctcttggacctcctggaggccccagatccgtccaccctggagaagttcctcggaacgatccccatggtgttcaatgtcgttatcctctcccctcatggttacttcgctcaagctaatgtcttgggttaccctgacaccggaggccaggttgtctacatcttggatcaagtgcgcgctatggagaacgaaatgctgctgaggatcaagcagtgtggtcttgacatcacgccgaagatccttatt

SEQ ID NO: 572 - DNA, 305 bp, Zea mays
cactgaggatgtttccagtgaaataatgaaagaaatgcaggccaagcctgaccttatcattggcaactacagcgatggcaacctagtcgccactctgctcgcgcacaagttgggagtcactcagtgtaccatcgctcatgccttggagaaaaccaaataccccaactcggacatatacttggacaaattcgacagccagtaccacttctcttgccagttcacagctgaccttattgccatgaaccacaccgatttcatcatcaccagcacattccaagaaatcgcgggaagcaaggacaccgtgg

SEQ ID NO: 573 - DNA, 306 bp, Zea mays
gacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggttggtggag

SEQ ID NO: 574 - DNA, 332 bp, Zea mays
ctcggagaggctgatgaccctcaccggcgtgtacgggttctggaagtacgtgtccaacctggagacgcgcgagacccggcggtacctggagatgctgtacgcgctcaagtaccgcaccatggcgagcaccgtgccgctggccgtggagggagagccctccagcaagtgatgcgtgacggcggccacagacctgatcgatcgatgagcgagagggagcactcggagtgtcgtgtcttttcccttgccatttctttctttcttctttttccttcccggaggcgaaaaaaaaagagtctgcatttgctaggcggcgggcgttcgttgctgctctt

SEQ ID NO: 575 - DNA, 309 bp, Zea mays
ggttacttcgctcaagctaatgtcttgggttaccctgacaccggagccaggttgtctacatcttggatcaagtgcgcgctatggagaacgaaatgctgctgaggatcaagcagtgtggtcttgacatcacgccgaagatccttattgtcaccaggttgctccctgatgcaactggcaccacctgtggccagcgacttgagaaggtccttggcaccgagcactgccatatccttcgcgtgccattcagaacagaaaacggaatcgttcgcaagtggatctcgcgatttgaagtctggccgtacctggaga

SEQ ID NO: 576 - DNA, 306 bp, Zea mays
cgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaag

SEQ ID NO: 577 - DNA, 300 bp, Zea mays
cggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaccgcgtccgcaacggcgagctgtaccgctaca

SEQ ID NO: 578 - DNA, 322 bp, Zea mays
ctcggttctgaacccagtgtcttgttgcgtgtttgctcgcccacaagatgggtgttactcactgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaa

SEQ ID NO: 579 - DNA, 336 bp, Zea mays
ccctgatgcaactggcaccacctgtggccagcgccttgagaaggtccttggcaccgagcactgccatatccttcgcgtgccattcagaacagaacacggaatcgctcgccagtggatctcgcgatttgaagtctggccgtacctggagacttacactgatgacgtggcgcatgagattgctggagagcttcaggccaatcctgacctgatcatcggaaactacagtgacggaaaccttgttgcgtgtttgctcgcccacaagatgggtgttactcactgtaccattgcccatgcgcttagaacactaagtacgctaactccgacctctactggaag

SEQ ID NO: 580 - DNA, 303 bp, Zea mays
gagaatttatgagaagtacacctggaagctctactccgagaggctgatgaccctgaccggcgtgtacgggttctggaagtacgtgagcaacctggagaggcgcgagacccgccgctacatcgaaatgttctacgccctgaagtaccgtagcctggcaagccaggttccgctgtccttcgattagtacggggaaagaagaagcccaggccggagaaccatcgcctgcatttcgatctgtttcaccgcaattcgcattgttagtcgtgtattggagttatgtgtacttggtttccaagaactttg

SEQ ID NO: 581 - DNA, 304 bp, Zea mays
gaccttcttgaggcccctgatcctgccaacttggagaagttccttggaactataccaatgatgttcaatgttgttatcctttctcctcatggctacttcgctcagtccaatgtgcttggataccctgacactggcggtcaggttgtgtacattctggatcaagtccgtgctttggagaatgagatgcttctgaggattaagcagcaaggccttgatatcactccgaagatcctcattgttaccaggctgttgcctgatgctgctgggactacgtgcggtcagcggctggagaaggtcattggta

SEQ ID NO: 582 - DNA, 304 bp, Zea mays
aagaaatcgcgggaagcaaggacaccgtggggcagtacgagtcccacatcgcgttcactcttcctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgagaactccgagcacaagttcgtgctgaaggacaagaagaagccgatcatcttctcgatggcgcgtctcgaccgcgtgaa

SEQ ID NO: 583 - DNA, 299 bp, Zea mays
cgcgctatggagaacgaaatgctgctgaggatcaagcagtgtggtcttgacatcacgccgaagatccttattgtcaccaggttgctccctgatgcaactggcaccacctgtggccagcgccttgagaaggtccttggcaccgagcactgccatatccttcgcgtgccattcagaacagaaaacggaatcgttcgcaagtggatctcgcgatttgaagtctggccgtacctggagacttacactgatgacgtggcgcatgagattgctggagagcttcaggccaatcctgacctgatcat

SEQ ID NO: 584 - DNA, 299 bp, Zea mays
gagaaaactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgca

SEQ ID NO: 585 - DNA, 296 bp, Zea mays
ggcaccacctgtggccagcgccttgagaaggtccttggcaccgagcactgccatatccttcgcgtgccattcagaacagaaaacggaatcgttcgcaagtggatctcgcgatttgaagtctggccgtacctggagacttacactgatgacgtggcgcatgagattgctggagagcttcaggccaatcctgacctgatcatcggaaactacagtgacggaaaccttgttgcgtgtttgctcgcccacaagatgggtgttactcactgtaccattgcccatgcgcttgagaaaactaa

SEQ ID NO: 586 - DNA, 301 bp, Zea mays
acttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgac

SEQ ID NO: 587 - DNA, 293 bp, Zea mays
gctaatgtcttgggttaccctgacaccggaggccaggttgtctacatcttggatcaagtgcgcgctatggagaacgaaatgctgctgaggatcaagcagtgtggtcttgacatcacgccgaagatccttattgtcaccaggttgctccctgatgcaactggcaccacctgtggccagcgccttgagaaggtccttggcaccgagcactgccatatccttcgcgtgccattcagaacagaaaacggaatcgttcgcaagtggatctcgcgatttgaagtctggccgtacctgga

SEQ ID NO: 588 - DNA, 296 bp, Zea mays
catggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacgtgaacgggcacatccgctggatctccgcccagatgaaccgcgtccgcaacggcgagctgtaccgctacatctgcgacaccaagggcgccttcgtgcagcctgctttctacgagg

SEQ ID NO: 589 - DNA, 305 bp, Zea mays
cccacgcgtccggagattgctggagagcatcaggccaatcctgacctgatcatcggaaactacagtgacggaaaccttgttgcgtgtttgctcgcccacaagatgggtgttactcactgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagta

SEQ ID NO: 590 - DNA, 297 bp, Zea mays
ctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcacgaagatgtttgacctcatcgagcagtacaacctgaacgggcacatccgctggatctccgcgcagatgaaccgc

SEQ ID NO: 591 - DNA, 299 bp, Zea mays
gccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctg

SEQ ID NO: 592 - DNA, 299 bp, Zea mays
cttctcttgccagttcacagctgaccttattgccatgaaccacaccgatttcatcatcaccagcacattccaagaaatcgcgggaagcaaggacaccgtggggcagtacgagtcccacatcgcgttcactcttcctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgaga

SEQ ID NO: 593 - DNA, 295 bp, Zea mays
caatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgca

SEQ ID NO: 594 - DNA, 302 bp, Zea mays
ctagtcgccactctgctcgcacacaagttgggagtcactcagtgtaccatcgctcatgccttggagaaaaccaaataccccaactcggacatctacttggacaagttcgacagccagtaccacttctcttgccagttcacagctgaccttattgccatgaaccacactgatttcatcatcaccagcacattccaagaaatcgcgggaagcaaggacaccgtggggcagtacgagtcccacatcgcgttcactcttcctgggctctaccgtgtcgtccatggcatcgatgttttcgatcccaa

SEQ ID NO: 595 - DNA, 314 bp, Zea mays
ctcggtgcagatgaaccgcgtccgcaacggggagctgtaccgctacatttgcgataccaagggcgcattcgtgcagcctgcgttctacgaagcgttcggcctgactgtgatcgagtccatgacgtgcggtctgccaacgatcgcgacctgccatggtggccctgctgagatcatcgtggacggggtatctggcctgcacattgacccttaccacagcgacaaggccgcggatatcctggtcaacttctttgacaaatgcaaggcagatccgagctactgggacaagatctcacagggcggcctgcagagaattt

SEQ ID NO: 596 - DNA, 356 bp, Zea mays
ctaccgtgtcgtccatggcatcgatgtattcgacacaagttcaacattgtctcccctggagcagacatgagtgattactacccgtatacggaaacccgacaagagactcactgccttccatcctgaaatcgatgagctcatctacagcgacgtcgagaactccgagcacaagttcgtgctgaaggacaagaagaagccgatcatcttctcgatagcgcgactcgaccgcgtgaagagacatgacaggcctggtcgagatgtacggcaagaacgcgcgcctgagggagctggcgaacctcgtgatcgttgccggtgaccacggcaaggagtccaaggacagggaggagcaggcggag

SEQ ID NO: 597 - DNA, 307 bp, Zea mays
gtggatctctcgttttgatgtctggccatacctggagacatacactgaggatgtttccagtgaaataatgaaagaaatgcaggccaagcctgaccttatcattggcaactacagcgatggcaacctagtcgccactctgctcgcgcacaagttgggagtcactcagtgtaccatcgctcatgccttggagaaaaccaaataccccaactcggacatatacttggacaaattcgacagccagtaccacttctcttgccagttcacagctgaccttattgccatgaaccacaccgatttcatcatcacc

SEQ ID NO: 598 - DNA, 319 bp, Zea mays
cggacgcgtgggtaccacttctcgtgccagttcaccactgacttgattgcaatgaaccatgccgacttcatcatcaccagtaccttccaagagatcgccggcaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaaca

SEQ ID NO: 599 - DNA, 303 bp, Zea mays
  unsure (1)..(303): unsure at all n locations
ggcgagctgtaccgctacatctgcgacaccaagggcgccttcgtgcagcctgctttctacgaggctttcgggctgacggtggttgacgccatgacctgcggcctgcccacgttcgccaccgcctacggcggtccggccgagatcatcgtgcacggcgtgtctggctaccacatcgacccttaccagggcgacaaggcgtcggccctgctcgtggacttcttcgacaagtgccaggcggagcgnagccactggagcaagatctcccagggcgggctccagcgtatcgaggagaagtacacctgg

SEQ ID NO: 600 - DNA, 291 bp, Zea mays
cccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcaca

SEQ ID NO: 601 - DNA, 309 bp, Zea mays
ctcccctcatggttacttcgctcaagctaatgtcttgggttaccctgacaccggaggccaggttgtctacatcttggatcaagtgcgcgctatggagaacgaaatgctgctgaggatcaagcagtgtggtcttgacatcacgccgaagatccttattgtcaccaggttgctccctgatgcaactggcaccacctgtggccagcgccttgagaaggtccttggcaccgagcactgccatatccttcgcgtgccattcagaacagaaaacggaatcgttcgcaagtggatctcgcgatttgaagtctggcc

SEQ ID NO: 602 - DNA, 323 bp, Zea mays
cccttaccacagcgacaaggccgcggatatcctggtcaacttctttgacaaatgcaaggcagatccgagctactgggacaagatctcacagggcggcctgcagagaatttatgagaagtacacctggaagctctactccgagaggctgatgaccctgaccggcgtgtacgggttctggaagtacgtgagcaacctggagaggcgcgagacccgccgctacatcgagatgttctacgccctgaagtaccgtagcctggcaagccaggttccgctgtccttcgattagtacggggaaagaagaagaagaagaagcccaggccgga

SEQ ID NO: 603 - DNA, 333 bp, Zea mays
  unsure (1)..(333): unsure at all n locations
gagtcgcacaagaggctgacctcccttcacccggagattgaggagctcctgtacagccanaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcgtgcgacatggcaacccttccaaggacaaggaggagcaggccgagttcaagaagatgtttgacctcatcgagcagtacaacctgaacgggcacatccgctggatctccgcccag

SEQ ID NO: 604 - DNA, 322 bp, Zea mays
cggaccgtggctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgt

SEQ ID NO: 605 - DNA, 290 bp, Zea mays
aaacttggtctggagaagggttggggtgattgcgctaagcgtgcacaggagactatccacctcctcttggacctcctggaggccccagatccgtccaccctggagaagttccttggaacgatccccatggtgttcaatgtcgttatcctctcccctcatggttacttcgctcaagctaatgtcttgggttaccctgacaccggaggccaggttgtctacatcttggatcaagtgcgcgctatggagaacgaaatgctgctgaggatcaagcagtgtggtcttgacatcac

SEQ ID NO: 606 - DNA, 306 bp, Zea mays
ggacctgggccgagttcaagaagatgtttgacctcatcgagcagtacaacctgaacgggcacatccgctggatctccgcccactatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggcc

SEQ ID NO: 607 - DNA, 293 bp, Zea mays
aaactaagtactctaactccgacctctactggaagaagtttgaggatcactaccacttctcgtgccaagtcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcg

SEQ ID NO: 608 - DNA, 314 bp, Zea mays
ccttggcaccgagcactgccatatccttcgcgtgccattcagaacagaaaacggaatcgttcgcaagtggatctcgcgatttgaagtctggccgtacctggagacttacactgatgacgtggcgcatgagatagctggagagcttcaggccaatcctgacctgatcatcggaaactacagtgacggaaaccttgttgcgtgtttgctcgcccacaagatgggtgttactcactgtaccattgcccatgcgcttgagaaaactaagtaccctaactccgacctctactggaagaagtctgaggatcactaccact

SEQ ID NO: 609 - DNA, 313 bp, Zea mays
cccacgcgtccgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgttcgccaccgcctacggcggtccggccgagatcatcgtgcacggcgtgtctggctaccacatcgacccttaccagggcgacaaggcgtcggccctgctcgtggacttcttcgacaagtgccaggcggagcgagccactggagcaag

SEQ ID NO: 610 - DNA, 295 bp, Zea mays
gttcaacatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaag

SEQ ID NO: 611 - DNA, 310 bp, Zea mays
ccggaggcaaaaaaagagtctgcttttgctaggcggcgggcgttcgttgctgctctttgcttcaagagttaaatttacctaccttgtcaaggtcttgttccatcattgatccgggtgtcgcttttttagtagtctgatggactgttagtagtttgcgttgcgtcggttgagagggaacgttggtggtggtggtgtgtgtgcagtcaggcgtggtgctccctttgtttcctggatgggatgttgctccttgaataataatcgtagtggccttggagcccttttcctgaaataagagcagcatcctagtgct

SEQ ID NO: 612 - DNA, 307 bp, Zea mays
cggaccgtgggatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgttcgccaccgcctacggcggtccggccgagatcatcgtgcacggcgtgtctggctaccacatcgacccttaccagggcgacaaggcgtcggccctgctcgtggacttcttcgacaagtg

SEQ ID NO: 613 - DNA, 302 bp, Zea mays
cactccctactcggagttcaaccataggttccaagagcttggtttggagaagggttggggtgacactgcgaacgtgtactcgacacactccacttgcttcttgaccttcttgaggcccctgatcctgccaacttggagaagttccttggaactataccaatgatgttcaatgttgttatcctttctcctcatggctacttcgctcagtccaatgtgcttggataccctgacactggcggtcaggttgtgtacattctggatcaagtccgtgctttggagaatgagatgcttctgaggattaa

SEQ ID NO: 614 - DNA, 304 bp, Zea mays
acagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcagcgaccatggcaacccttccaaggacaaggaggagcaggccgagttcaagaagatgtttgacctcatcgagcagtacaacctgaacgagcacatccgctggatcatccgccagatgaaccgcgtccgcaacggcga

SEQ ID NO: 615 - DNA, 295 bp, Zea mays
ataagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgttcgccaccgcctacggcagtccggccgagatcatcgtgcacggcgtgtctggctaccacatcgactcttaccagggcgacaaggcgtcggccctgctcgt

SEQ ID NO: 616 - DNA, 288 bp, Zea mays
cggaaactacagtgacggaaaccttgttgcgtggttgctcgcccacaagatgggtgttactcactgtaccattgcccatgcgcttgagaaaactaagtaccctaactccgacctctactggaagaagtttgaggatcactaccacttctcgtgccagttcaccactgacttgattgcaatgaaccattgccgacttcatcatcaccagtaccttccaagagatcgccggaaacaaggacaccgtcggccagtacgagtcacacatggcgttcacaatgcctggcctgt

SEQ ID NO: 617 - DNA, 301 bp, Zea mays
cccacgcgtccgcacctcctcttggacctcctggaggccccagatccgtccaccctggagaagttccttggaacgatccccatggtgttcaatgtcgttatcctctcccctcatggttacttcgctcaagctaatgtcttgggttaccctgacaccggaggccaggttgtctacatcttggatcaagtgcgcgctatggagaacgaaatgctgctgaggatcaagcagtgtggtcttgacatcacgccgaagatccttattgtcaccaggttgctccctgatgcaactggcaccacctgtg

SEQ ID NO: 618 - DNA, 294 bp, Zea mays
  unsure (1)..(294): unsure at all n locations
acctgcggcctgcccacgttcgccaccgcctacgggggtccggccgagatcatcgtgcacggcgtgtctggctaccacatcgacccttaccagggcgacaaggcgtcggccctgctcgtggacttcttcgacaagtgccaggcggagcgnagccactggagcaagatctcccagggcgggctccagcgtatcgaggagaagtacacctggaagctgtactcggagaggctgatgaccctcaccggcgtgtacgggttctggaagtacgtgtccaacctggagaggcgcgagacc

SEQ ID NO: 619 - DNA, 287 bp, Zea mays
gctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcg

SEQ ID NO: 620 - DNA, 303 bp, Zea mays
agctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaccgcgtcc

SEQ ID NO: 621 - DNA, 298 bp, Zea mays
ccaagttcaacatcgtgtctcctggcgcggacctgtccatctacttcccgtacaccgagtcgcacaagaggctgacctcccttcacccggagattgaggagctcctgtacagccaaaccgagaacacggagccacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttcca

SEQ ID NO: 622 - DNA, 306 bp, Zea mays
  unsure (1)..(306): unsure at all n locations
aacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgttcgccaccgcctacggcggtccggccgagatcatcgtgcacggcgtgtctggctaccacatcgacccttaccagggcgacaaggcgtcggccctgctcgtggacttcttcgacaagtgccaggcggagcgangccactgg

SEQ ID NO: 623 - DNA, 292 bp, Zea mays
actcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagccctccagcaagtgatgcgcgacggcggccacagacctgatcgatcgatgagcgagagggagcactcggagtgtcgtgtcttttcccttgccatttctttctttttttcccttcccggaggcgaaaaaaagagtctg

SEQ ID NO: 624 - DNA, 283 bp, Zea mays
caggccaatcctgacctgatcatcggaaactacagtgacggaaaccttgttgcgtgtttgctcgcccacaagatgggtgttactcactgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcac

SEQ ID NO: 625 - DNA, 289 bp, Zea mays
ggcgaacctcgtgatcgtcgccggtgaccacggcaaggagtccaaggacagggaggagcaggcggagttcaagaagatgtacagcctcatcgacgagtacaagttgaagggccatatccggtggatctcggcgcagatgaaccgcgtccgcaacggggagctgtaccgctacatttgcgataccaagggcgcattcgtgcagcctgcgttctacgaagcgttcgggctgactgtgatcgagtccatgacgtgcggtctgccaacgatcgcgacctgccatggtggccct

SEQ ID NO: 626 - DNA, 295 bp, Zea mays
cccacgcgtccgcttggatcaagtgcgcgctatggagaacgaaatgctgctgaggatcaagcagtgtggtcttgacatcacgccgaagatccttattgtcaccaggttgctccctgatgcaactggcaccacctgtggccagcgccttgagaaggtccttggcaccgagcactgccatatccttcgcgtgccattcagaacagaaaacggaatcgttcgcaagtggatctcgcgatttgaagtctggccgtacctggagacttacactgatgacgtggcgcatgagattgctgga

SEQ ID NO: 627 - DNA, 283 bp, Zea mays
ggagaacgaaatgctgctgaggatcaagcagtgtggtcttgacatcacgccgaagatccttattgtcaccaggttgctccctgatgcaactggcaccacctgtggccagcgccttgagaaggtccttggcaccgagcactgccatatccttcgcgtgccattcagaacagaaaacggaatcgttcgcaagtggatctcgcgatttgaagtctggccgtacctggagacttacactgatgacgtggcgcatgagattgctggagagcttcaggccaatcctgac

SEQ ID NO: 628 - DNA, 299 bp, Zea mays
cccacgcgtccgtgagtgtttactacccgtatacggaaaccgacaagagactcactgccttccatcctgaaatcgaggagctcatctacagcgacgtcgagaactccgagcacaagttcgtgctgaaggacaagaagaagccgatcatcttctcgatggcgcgtctcgaccgcgtgaagaacatgacaggcctggtcgagatgtacggcaagaacgcgcgcctgagggagctggcgaacctcgtgatcgttgccggtgaccacggcaaggagtccaaggacagggaggagcaggcggag

SEQ ID NO: 629 - DNA, 286 bp, Zea mays
cgcgatttgaagtctggccgtacctggagacttacactgatgacgtggcgcatgagattgctggagagcttcaggccaatcctgacctgatcatcggaaactacagtgacggaaaccttgttgcgtgtttgctcgcccacaagatgggtgttactcactgtaccattgcccatgcgcttgagaaaactaagtaccctaactccgacctctactggaagaagtttgaggatcactaccacttctcgtgccagttcaccacagacttgattgcaatgaaccatgccga

SEQ ID NO: 630 - DNA, 293 bp, Zea mays
caggaacttggtctggagaagggttggggtgattgcgctaagcgtgcacaggagactatccacctcctcttggacctcctggaggccccagatccgtccaccctggagaagttccttggaacgatccccatggtgttcaatgtcgttatcctctcccctcatggttacttcgctcaagctaatgtcttgggttaccctgacaccggaggccaggttgtctacatcttggatcaagtgcgcgctatggagaacgaaatgctgctgaggatcaagcagtgtggtcttgacatcac

SEQ ID NO: 631 - DNA, 286 bp, Zea mays
gaacgaaatgctgctgaggatcaagcagtgtggtcttgacatcacgccgaagatccttattgtcaccaggttgctccctgatgcaactggcaccacctgtggccagcgccttgagaaggtccttggcaccgagcactgccatatccttcgcgtgccattcagaacagaaaacggaatcgttcgcaagtggatctcgcgatttgaagtctggccgtacctggagacttacactgatgacgtggcgcatgagattgctggagagcttcaggccaatcctgacctgatc

SEQ ID NO: 632 - DNA, 289 bp, Zea mays
cctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcg

SEQ ID NO: 633 - DNA, 308 bp, Zea mays
  unsure (1)..(308): unsure at all n locations
cggacggtggncgagacgcgtgggctgacaccggaggccaggttgtctacatcttggatcaagtgcgcgctatggagaacgaaatgctgctgaggatcaagcagtgtggtcttgacatcacgccgaagatccttattgtcaccaggttgctccctgatgcaactggcaccacctgtggccagcgccttgagaaggtccttggcaccgagcactgccatatccttcgcgtgccattcagaacagaaaacggaatcgttcgcaagtggatctcgcgatttgaagtctggccgtacctggagacttacact

SEQ ID NO: 634 - DNA, 286 bp, Zea mays
ggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgttcgccaccgcctacgggggtccggccgagatcatcgtgcacggcgtgtcgggctaccacatcgacccttac

SEQ ID NO: 635 - DNA, 281 bp, Zea mays
ccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaag

SEQ ID NO: 636 - DNA, 282 bp, Zea mays
ggttacttcgctcaagctaatgtcttgggttaccctgacaccggaggccaggttgtctacatcttggatcaagtgcgcgctatggagaacgaaatgctgctgaggatcaagcagtgtggtcttgacatcacgccgaagatccttattgtcaccaggttgctccctgatgcaactggcaccacctgtggccagcgccttgagaaggtccttggcaccgagcactgccatatccttcgcgtgccattcagaacagaaaacggaatcgttcgcaagtggatctcg

SEQ ID NO: 637 - DNA, 279 bp, Zea mays
catactctgaatttcaccacaggttccaggaacttggtctggagaagggttggggtgattgcgctaagcgtgcacaggagactatccacctcctcttggacctcctggaggccccagatccgtccaccctggagaagttccttggaacgatccccatggtgttcaatgtcgttatcctctcccctcatggttacttcgctcaagctaatgtcttgggttaccctgacaccggaggccaggttgtctacatcttggatcaagtgcgcgctatggagaacg

SEQ ID NO: 638 - DNA, 356 bp, Zea mays
  unsure (1)..(356): unsure at all n locations
cgcgcttgttccggccgtacagctccaccagcccagtcaagttcttcacacggtcgagacgagccatggagaagaccattggcttgttcctgtcgttcagaacgaacttgtgctccgtgttctcggtttggctgtacaggagctcctcaatctccgggtgaagggaggtcagcctcttgtgcgactcggtgtacgggaagtagatggacaggtccgcgccaggagacacgatgttgaacttggggtcgaacacatcaatgccgtggacaacgcggtacangccaggcattgtgaacgccatgtgtgactcgtactggccgacggtgtccttgtttccggcgatctctatggaagta

SEQ ID NO: 639 - DNA, 288 bp, Zea mays
accacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgt

SEQ ID NO: 640 - DNA, 294 bp, Zea mays
ggccgagatcatcgtgcacggcgtgtctggctaccacatcgacccttaccagggcgacaaggcgtcggccctgctcgtggacttcttcgacaagtgccaggcggagcgagtccactggagcaagatctcccagggcgggctccagcgtatcgaggagaagtacacctggaagctgtactcggagaggctgatgaccctcaccggcgtgtacgggttctggaagtacgtgtccaacctggagaggcgcgagacccggcggtacctggagatgctgtacgcgctcaagtaccgcac

SEQ ID NO: 641 - DNA, 311 bp, Zea mays
  unsure (1)..(311): unsure at all n locations
cggacgcttggtntcgacaagtgccaggcggagcgangccactggagcaagatctcccagggcgggctccangcgtatcgaggagaagtacacctggaagctgtactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagcccnccagcaagtgatgcgtgacggcggccacagacctgatcgatcgatgag

SEQ ID NO: 642 - DNA, 282 bp, Zea mays
agctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctgggcaacctcgtggtcgtctgcggcgaccatggcaacccttccaaggacaaggaggagcaggccgagttcaagaagatgtttgacctcatcgagcagtacaacctgaacgggcacatccgctggatct

SEQ ID NO: 643 - DNA, 284 bp, Zea mays
aaggacaccgtggggcagtacgagtcccacatcgcgttcactcttcctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgagaactccgagcacaagttcgtgctgaaggacaagaagaagccgatcatcttctcgatggcgcgtctcgaccgcgt

SEQ ID NO: 644 - DNA, 276 bp, Zea mays
gttcaacatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcga

SEQ ID NO: 645 - DNA, 282 bp, Zea mays
cccttggaacgatccccatggtgttcaatgtcgttatcctctcccctcatggttacttcgcacaagctaatgtcttgggttaccctgacaccggaggccaggttgtctacatcttggatcaagtgcgcgctatggagaacgaaatgctgctgaggatcaagcagtgtggtcttgacatcacgccgaagatccttattgtcaccaggttgctccctgatgcaactggcaccacctgtggccagcgccttgagaaggtccttggcaccgagcactgccatatcc

SEQ ID NO: 646 - DNA, 286 bp, Zea mays
gttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgtacgggttctggaagtacgtgtcca

SEQ ID NO: 647 - DNA, 280 bp, Zea mays
gtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacacc

SEQ ID NO: 648 - DNA, 286 bp, Zea mays
cgatcatcgtgcacggcgtgtctggctaccacatcgacccttaccagggcgacaaggcgtcggccctgctcgtggacttcttcgacaagtgccaggcggaccgagccactggagcaagatctcccagggcgggctccagcgtatcgaggagaagtacacctggaagctgtactcggagaggctgatgaccctcaccggcgtgtacgggttctggaagtacgtgtccaacctggagaggcgcgagacccggcggtacctggagatgctgtacgcgctcaagtaccgc

SEQ ID NO: 649 - DNA, 331 bp, Zea mays
  unsure (1)..(331): unsure at all n locations
cacatcgacccttaccagggcgacaaggcgtcggccctgctcgtggacttcttcgacaagtgccagcgtatcgaggagaagtacacctggaagctgtactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagccctccagcaagtgatgcgtgacggcggcnacagacctgatcgatcgatgagcgagatggagcactcggagtgtcgtgt

SEQ ID NO: 650 - DNA, 288 bp, Zea mays
gtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgttcgccaccgcctacggcgtaccggccgagatcatcgtgcacggcgtgtctggctaccacatcgacccttaccagggcgacaaggcgtcggccctgctcgt

SEQ ID NO: 651 - DNA, 304 bp, Zea mays
gggttctggaagtacgtgtccaacctggagaggcgcgagacccggcggtacctggagatgctgtacgcgctcaagtaccgcaccatggcgagcaccgtgccgctggccgtggagggagagccctccagcaagtgatgcgcgacggcggccacagacctgatcgatcgatgagcgagagggagcactcggagtgtcgtgtcttttcccttgccatttctttctttttttcccttcccggaggcgaaaaaaagagtctgcttttgctaggcggcgggcgttcgttgctgctcattgcttcaagagt

SEQ ID NO: 652 - DNA, 285 bp, Zea mays
cggctcgagctgagcacacagacatcattcgcgttcccttcagaaatgagaatggcatcctccgcaagtggatctctcgttttgatgtctggccatacctggagacatacactgaggatgtttccagtgaaataatgaaagaaatgcaggccaagcctgaccttatcattggcaactacagcgatggcaacctagtcgccactctgctcgcgcacaagttgggagtcactcagtgtaccatcgctcatgccttggagaaaaccaaataccccaactcggacatat

SEQ ID NO: 653 - DNA, 289 bp, Zea mays
gcacctgtccaccctacaagctgataccccatactctgaatttcaccacaggttccaggaacttggtctggagaagggttggggtgattgcgctaagcgtgcacaggagactatccacctcctcttggacctcctggaggccccagatccgtccaccctggagaagttccttggaacgatccccatggtgttcaatgtcgttatcctctcccctcatggttacttcgctcaagctaatgtcttgggttaccctgacaccggaagccaggttgtctacatcttggatcaa

SEQ ID NO: 654 - DNA, 275 bp, Zea mays
cccttccaaggacaaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgttcgccaccgcctacggcggtccggccgagatcatcgtgcacggcg

SEQ ID NO: 655 - DNA, 278 bp, Zea mays
gttccttggaacgatccccatggtgttcaatgtcgttatcctctcccctcatggttacttcgctcaagctaatgtcttgggttaccctgacaccggaggccaggttgtctacatcttggatcaagtgcgcgctatggagaacgaaatgctgctgaggatcaagcagtgtggtcttgacatcacgccgaagatccttattgtcaccaggttgctccctgatgcaactggcaccacctgtggccagcgccttgagaagctccttggcaccgagcactgcc

SEQ ID NO: 656 - DNA, 296 bp, Zea mays
gaaaactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgc

SEQ ID NO: 657 - DNA, 278 bp, Zea mays
aagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcat

SEQ ID NO: 658 - DNA, 306 bp, Zea mays
  unsure (1)..(306): unsure at all n locations
ctggaggccccagatccgtccaccctggagaagttccttggaacgatccccatggtgttacaatgtcgttatcctctcccctcatggttacttcgctcaagctaatgtcttgggttaccctgacaccggaggccaggttgtctacatcttggatcaagtgcgcgctatggagaacgaaatgctgctgaggatcaagcagtgtggtcttgacatcacgccgaagatccttattgtcaccaggttgcnccctgatgcaagtggcaccacctgtggccagcgctttgagagggtcttggccccgaacat

SEQ ID NO: 659 - DNA, 306 bp, Zea mays
ctcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagccctccagcaagtgatgcgcgacggcggccacagacctgatcgatcgatgagcgagagggagcactcggagtgtcgtgtcttttcccttgccatttctttctttttttcccttcccggaggcgaaaaaaagagtctgcttttgctaggcggc

SEQ ID NO: 660 - DNA, 287 bp, Zea mays
cggaccgtgggcgtggcgcatgagattgctggagagcttcaggccaatcctgacctgatcatcggaaactacagtgacggaaaccttgttgcgtgtttgctcgcccacaagatgggtgttactcactgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtaccttccaagagatcgc

SEQ ID NO: 661 - DNA, 276 bp, Zea mays
aagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatct

SEQ ID NO: 662 - DNA, 276 bp, Zea mays
ggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagcctcc

SEQ ID NO: 663 - DNA, 274 bp, Zea mays
gaatttcaccacaggttccaggaacttggtctggagaagggttggggtgattgcgctaagcgtgcacaggagactatccacctcctcttggacctcctggaggccccagatccgtccaccctggagaagttccttggaacgatccccatggtgttcaatgtcgttatcctctcccctcatggttacttcgctcaagctaatgtcttgggttaccctgacaccggaggccaggttgtctacatcttggatcaagtgcgcgctatggagaacgaaa

SEQ ID NO: 664 - DNA, 308 bp, Zea mays
gaccacgcgtcgacagcgtccgggacctggggccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatgg

SEQ ID NO: 665 - DNA, 279 bp, Zea mays
tgcccatgcgcttgagaaaactaagtaccctaactccgacctctactggaagaagtttgaggatcactaccacttctcgtgccagttcaccacagacttgattgcaatgaaccatgccgacttcatcatcaccagtaccttccaagagatcgccggaaacaaggacaccgtcggccagtacgagtcacacatggcgttcacaatgcctggcctgtaccgcgtcgtccacggcattgatgtgttcgaccccaagttcaacatcgtgtctcctggcgcgga

SEQ ID NO: 666 - DNA, 277 bp, Zea mays
atccccatggtgttcaatgtcgttatcctctcccctcatggttacttcgctcaagctaatgtcttgggttaccctgacaccggaggccaggttgtctacatcttggatcaagtgcgcgctatggagaacgaaatgctgctgaggatcaagcagtgtggtcttgacatcacgccgaagatccttattgtcaccaggttgctccctgatgcaactggcaccacctgtggccagcgccttgagaaggtccttggcaccgagcactgccatatccttcgcg

SEQ ID NO: 667 - DNA, 284 bp, Zea mays
cctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgagaactccgagcacaagttcgtgctgaaggacaagaagaagccgatcatcttctcgatggcgcgtctcgaccgcgtgaagaacatgacaggcctggtcgagatgtacggcaagaacgcgcg

SEQ ID NO: 668 - DNA, 286 bp, Zea mays
ctgaaatcgaggagctcatctacagcgacgtcgagaactccgagcacaagttcgtgctgaacgacaagaagaagccgatcatcttctcgatggcgcgtctcgaccgcgtgaagaacatgacaggcctggtcgagatgtacggcaagaacgcgcgcctgacggagctggcgaacctcgtgatcgttgccggtgaccacggcaaggagtccaaggacagggaggagcaggcggagttcaagaagatgtacagcctcatcgacgagtacgagttgaagggccatatccg

SEQ ID NO: 669 - DNA, 271 bp, Zea mays
tctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggagga

SEQ ID NO: 670 - DNA, 273 bp, Zea mays
cccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccagggacaaggaggagcaggccga

SEQ ID NO: 671 - DNA, 270 bp, Zea mays
ctcatctacagcgacgtcgagaactccgagcacaagttcgtgctgaaggacaagaagaagccgatcatcttctcgatggcgcgtctcgaccgcgtgaagaacatgacaggcctggtcgagatgtacggcaagaacgcgcgcctgagggagctggcgaacctcgtgatcgttgccggtgaccacggcaaggagtccaaggacagggaggagcaggcggagttcaagaagatgtacagcctcatcgacgagtacaagttgaagggccatatc

SEQ ID NO: 672 - DNA, 271 bp, Zea mays
agattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaa

SEQ ID NO: 673 - DNA, 274 bp, Zea mays
gagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttg

SEQ ID NO: 674 - DNA, 269 bp, Zea mays
cctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatc

SEQ ID NO: 675 - DNA, 273 bp, Zea mays
ctgtggccagcgccttgagaaggtccttggcaccgagcactgccatatccttcgcgtgccattcagaacagaaaacggaatcgttcgcaagtggatctcgcgatttgaagtctggccgtacctggagacttacactgatgacgtggcgcatgagattgctggagagcttcaggccaatcctgacctgatcatcggaaactacagtgacggaaaccttgttgcgtgtttgctcgcccacaagatgggtgttactcactgtaccattgcccatgc

SEQ ID NO: 676 - DNA, 285 bp, Zea mays
ccaagggcgccttcgtgcagcctgctttctacgaggctttcgggctgacggtggttgacgccatgacctgcggcctgcccacgttcgccaccgcctacggcggtccggccgagatcatcgtgcacggcgtgtctggctaccacatcgacccttaccagggcgacaaggcgtcggccctgctcgtggacttcttcgacaagtgccaggcggaccgagccactggagcaagatctcccagggcgggctccagcgtatcgaggagaagtacacctggaagctgtactc

SEQ ID NO: 677 - DNA, 281 bp, Zea mays
atcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgttcgccaccgcctacggcggtccggccgagatcatcgtgcacggcgtgtctggctaccacatcgacccttaccagggcgacaaggcgtcggccctgctcgtgga

SEQ ID NO: 678 - DNA, 297 bp, Zea mays
ctggagcagacatgagtgtttactacccgtatacggaaaccgacaagagactcactgccttccatcctgaaatcgaggagctcatcaacagcgacgtcgagaactccgagcacaagttcgtgctgaaggacaagaagaagccgatcatcttctcgatggcgcgtctcgaccgcgtgaagaacatgacaggcctggtggagatgtacggcaagaacgcgcgcctgagggagctggcgaacctcgtgatcgtcgccggtgaccacggcaagagtccaaggacagggaggagcaggcgga

SEQ ID NO: 679 - DNA, 273 bp, Zea mays
cgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgtacgggttctggaagtacgtgtccaacctggagaggcgcgagacccggcggtacctggagatgctgtacgcgctcaa

SEQ ID NO: 680 - DNA, 279 bp, Zea mays
gtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttca

SEQ ID NO: 681 - DNA, 283 bp, Zea mays
cgcgttcactcttcctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatcaacagcgacgtcgagaactccgagcacaagttcgtgctgaaggacaagaagaagccgatcatcttctcgatggcgcgtctcgaccgcgtgaagaacatgacaggcctggtggagatgtac

SEQ ID NO: 682 - DNA, 302 bp, Zea mays
taccgagatcatcgtgcacggcgtgtctggctaccacatcgacccttaccagggcgacaaggcgtcggccctgctcgtggagttcttcgacaagtgccaggcggacccgagccactggagcaagatctcccagggcgggctccagcgtatcgaggagaagtacacctggaagctctactcggagaggctgatgaccctcaccggcgtgtacgggttctggaagtacgtgtccaacctggagaagcgcgatacccggcggtacctggaggagctgtacgcgctcaagtaccgcaccatggcga

SEQ ID NO: 683 - DNA, 300 bp, Zea mays
agaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgttcgccaccgcctacggcggtccggccgagatcatcgtgcacggcgtgtctggcctacacatcggaccttacccaggcgacaaagcgtcggcactgctcgtggact

SEQ ID NO: 684 - DNA, 264 bp, Zea mays
ggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctacca

SEQ ID NO: 685 - DNA, 325 bp, Zea mays
gtcggaacaagcggctgcaggagctggtgacctcgtggtcgtctgcggcgaccatggcaacccttccaaggacaaggatgatcaggccgagttcaagaagatgtttgacctcatcgagcagtacaacctgaacgggtacatccgctggatctccgcccagatgaaccgcgtccgcaacggcgagctgtaccgctacatctgcgacaccataggcgccttcgtgcagcctgctttctacgaggctttcgggctgacggtggttgaagctatgacctgcggcctgcccgagttcgccaccgcctagagggtccggccagatcatcgt

SEQ ID NO: 686 - DNA, 291 bp, Zea mays
ggacctgggaagtacacctggaagctgtactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagccctccagcaagtgatgcgtgacggcggccacagacctgatcgatcgatgagcgagagggagcactcggagtgtcgtgtcttttcccttgccatttctttctttcttc

SEQ ID NO: 687 - DNA, 279 bp, Zea mays
gcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcagg

SEQ ID NO: 688 - DNA, 270 bp, Zea mays
  unsure (1)..(270): unsure at all n locations
gccctgctcgtggacttcttcgacaagtgccaggcggagcgagccactggagcaagatctcccagggcgggctccagcgtatcgaggagaagtacacctggaagctgtactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggnaggagagccctcag

SEQ ID NO: 689 - DNA, 274 bp, Zea mays
ggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgta

SEQ ID NO: 690 - DNA, 267 bp, Zea mays
cggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatga

SEQ ID NO: 691 - DNA, 268 bp, Zea mays
gccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggat

SEQ ID NO: 692 - DNA, 273 bp, Zea mays
cgagaacacggagcacaagttcgttctgaacgacaggaaggggccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagat

SEQ ID NO: 693 - DNA, 268 bp, Zea mays
gagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgccca

SEQ ID NO: 694 - DNA, 280 bp, Zea mays
cccacgcgtccgggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgccc

SEQ ID NO: 695 - DNA, 270 bp, Zea mays
tgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcga

SEQ ID NO: 696 - DNA, 282 bp, Zea mays
cggaccgtgggctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcac

SEQ ID NO: 697 - DNA, 285 bp, Zea mays
ccttcgtgcgtccttctctgtcaaagtccattggcaatggcgtgcagttcctcaacaggcacctgtcatcaaagctcttccatgacaaggagagcatgtaccccttgctcaacttccttcgcgcccacaactacaaggggatgaccatgatgttgaacgacagaatccgcagtctcagtgctctgcaaggtgcgctgaggaaggctgaggagcacctgtccaccctacaagctgataccccatactctgaatttcaccacaggttccaggaacttggtctggaga

SEQ ID NO: 698 - DNA, 264 bp, Zea mays
gttcgcaagtggatctcgcgatttgaagtctggccgtacctggagacttacactgatgacgtggcgcatgagattgctggagagcttcaggccaatcctgacctgatcatcggaaactacagtgacggaaaccttgttgcgtgtttgctcgcccacaagatgggtgttactcactgtaccattgcccatgcgcttgagaaaactaagtaccctaactccgacctctactggaagaagtttgaggatcactaccacttctcgtgc

SEQ ID NO: 699 - DNA, 264 bp, Zea mays
gagaaaactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcg

SEQ ID NO: 700 - DNA, 264 bp, Zea mays
ggactttgagccattcaatgcctccttcccccgtccttctctgtcaaagtccattggcaatggcgtgcagttcctcaacaggcacctgtcatcaaagctcttccatgacaaggagagcatgtaccccttgctcaacttccttcgcgcccacaactacaaggggatgaccatgatgttgaacgacagaatccgcagtctcagtgctctgcaaggtgcgctgaggaaggctgaggagcacctgtccaccctacaagctgatacccc

SEQ ID NO: 701 - DNA, 288 bp, Zea mays
cccacgcgtccgcggaccgtgggatggtgttcaatgtcgttatcctctcccctcatggttacttcgctcaagctaatgtcttgggttaccctgacaccggatgccaggttgtatacatcttggatcaagtgcgcgctatggagaacgaaatgctgctgaggatcaagcagtgtggtcttgacatcacgccgaagatccttattgtcaccaggttgctccctgatgcaactggcaccacctgtggccagcgccttgagaaggtccttggcaccgagcactgccatatcc

SEQ ID NO: 702 - DNA, 268 bp, Zea mays
agcgtatcgaggagaagtacacctggaagctctactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagccctccagcaagtgatgcgcgacggcggccacagacctgatcgatcgatgagcgagagggagcactcggagtgtcgtgtc

SEQ ID NO: 703 - DNA, 265 bp, Zea mays
gagaaaactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcgg

SEQ ID NO: 704 - DNA, 228 bp, Zea mays
gttcaacatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagttgtacggccg

SEQ ID NO: 705 - DNA, 297 bp, Zea mays
cggacgcgtgggcggacgcgtgggcaagaggctgacctcccttcacccggagattgaggagctcctgtacagccaaaccgagaacacggagcacaagttcgatctgaacgacagcgaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttg

SEQ ID NO: 706 - DNA, 286 bp, Zea mays
attgacccttaccacagcgacaaggccgcggatatcctggtcaacttctttgacaaatgcaaggcagatccgagctactgggacaagatctcacagggcggcctgcagagaatctatgagaagtacacctggaagctctactccgagaggctgatgaccctgaccggcgtgtacgggttctggaagtacgtgagcaacctggagaggcgcgagacccgccgctacatcgagatgttctacgccctgaagtaccgtagcctggcaagccagggtccgctgtccttcg

SEQ ID NO: 707 - DNA, 272 bp, Zea mays
gagaagggttggggtgattgcgctaagcgtgcacaggagactatccacctcctcttggacctcctggaggccccagatccgtccaccctggagaagttccttgtacgatccccatggtgttcaatgtcgttatcctctcccctcatggttacttcgctcaagctaatgtcttgggttaccctgacaccggaggccaggttgtctacatcttggatcaagtgcgtgctatggagaacgaaatgctgctgaggatcaagcagtgtggtcttgac

SEQ ID NO: 708 - DNA, 299 bp, Zea mays
acctgatcctgccaacttggagaagttccttggaactataccaatgatgttcaatgttgttatcctttctcctcatggctacttcgctcagtccaatgtgcttggataccctgacactggcggtcaggttgtgtacattctggatcaagtccgtgctttggagaatgagatgcttctgaggattaagcagcaaggccttgatatcactccgaagatcctcattgttaccaggctgttgcctgatgctgctgggactacgtgcggtcatcggctggagaaggtcattggtactgagcaca

SEQ ID NO: 709 - DNA, 329 bp, Zea mays
acgcaccgaccacggtccgcgacctgggtcgctggctgaacgggcacatccgctggatctccgcccagctgaaccgcgtccgcaacgacgagctgtaccgctacatctgcgacaccaagggcgccttcgtgcagcctgctttctacgaggctttcgggctgacggtggttgacgccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggctgacccg

SEQ ID NO: 710 - DNA, 287 bp, Zea mays
tgagattgctggagagcttcaggccaatcctgacctgatcatcggatactacagtgacggataccttgttgcgtgtttgctcgcccacaagatgggtgttactcactgtaccattgcccatgcgcttgataaaactaagtaccctaactccgacctctactggaagaagtttgatgatcactaccacttctcgtgccagttcaccactgacttgattgctatgaaccatgccgacttcatcatcaccagtaccttccaagagatcgccggatacaaggacaccgtcg

SEQ ID NO: 711 - DNA, 290 bp, Zea mays
gggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgagaactccgagcacaagttcgtgctgaaggacaagaagaagcccctcatcttctcgatggcgcgtctcgaccgcgtgaagaacatgacaggcctggtcgagatgtacggcaagaacgcgcgcctgaggga

SEQ ID NO: 712 - DNA, 290 bp, Zea mays
cccacgcgtccgttcctcaacacgcacctcccatcaaagctcttccatgacaaggagagcatgtaccccttgctcaacttccttcgcgcccacaactacaaggggaccaccatgatgttgaacgacagactccgcagtctcagtgctctgcaaggtgcgctgaggaaggctgaggagcacctgtccaccctacaagctgataccccatactctgaatttcaccacaggttccaggaacttggtctggagaagggttggggtgattgcgctaagcgtgcacaggagactat

SEQ ID NO: 713 - DNA, 274 bp, Zea mays
caacaactttgttcttgagctggactttgagccattcaatgcctccttcccccgtccttctctgtcaaagtccattggcaatggcgtgcagttcctcaacaggcacctgtcatcaaagctcttccatgacaaggagagcatgtaccccttgctcaacttccttcgcgcccacaactacaaggggatgaccatgatgttgaacgacagaatccgcagtctcagtgctctgcaaggtgcgctgaggaaggctgaagagcacctgtccaccctacaa

SEQ ID NO: 714 - DNA, 270 bp, Zea mays
ctgatttcatcatcaccagcacattccaagaaatcgcgggaagcaaggacaccgtggggcagtacgagtcccacatcgcgttcactcttcctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatcaacagcgacgtcgagaactccgagcacaagt

SEQ ID NO: 715 - DNA, 267 bp, Zea mays
gttcctcaacaggcacctgtcatcaaagctcttccatgacaaggagagcatgtaccccttgctcaacttccttcgcgcccacaactacaaggggatgaccatgatgttgaacgacagaatccgcagtctcagtgctctgcaaggtgcgctgaggaaggctgaggagcacctgtccaccctacaagctgataccccatactctgaatttcaccacaggttccaggaacttggtctggagaagggttggggtgattgcgctaagcgtgc

SEQ ID NO: 716 - DNA, 262 bp, Zea mays
cctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatct

SEQ ID NO: 717 - DNA, 278 bp, Zea mays
gaggatcactaccacttctcgtgccagttcaccactgacttgattgctatgaaccatgccgacttcatcatcaccagtaccttccaagagatcgccggatacaaggacaccgtcggccagtacgagtcacacatggcgttcacaatgcctggtctgtaccgcgttgtccacggcattgatgtgttcgaccccaagttcaacatcgtgtctcctggcgcggacctgtccatctacttcccgtacaccgagtcgcacaagatgctgacctcccttcaccc

SEQ ID NO: 718 - DNA, 263 bp, Zea mays
ggtgattgcgctaagcgtgcacaggagactatccacctcctcttggacctcctggaggccccagatccgtccaccctggagaagttccttggaacgatccccatggtgttcaatgtcgttatcctctcccctcatggttacttcgctcaagctaatgtcttgggttaccctgacaccggaggccaggttgtctacatcttggatcaagtgcgcgctatggagaacgaaatgctgctgaggatcaagcagtgtggtcttgacat

SEQ ID NO: 719 - DNA, 289 bp, Zea mays
acaacctgaacgggcacatccgctggatctccgcccagatgaaccgcgtccgcaacggcgagctgtaccgctaactctgcgacaccaagggcgccttcgtgcagcctgcattctacgaggctttcgggctgacggtggttgaggccatgacctgcggcctgcccacgttcgccaccgcctacggcgtaccggccgagatcatcgtgcacggcgtgtcgggctaccacatcgacccttaccagggcgacaaggcgtcggccctgctcgtggacttcttcgacaagtgcca

SEQ ID NO: 720 - DNA, 299 bp, Zea mays
caggcacctgtcatcaaagctcttccatgacaaggagagcatgtaccccttgctcaacttccttcgcgcccacaactacaaggggatgaccatgatgttgaacgacagaatccgcagtctcagtgctctgcaaggtgctctgaggaaggctgaggagcacctggcaccctacaagctgataccccatactctgaatttcaccacaggttccaggaacttggtctggagaagggttggggtgattgcgctaagcgtgcacaggagactatccacctcctcttggacctcctggaggcccc

SEQ ID NO: 721 - DNA, 308 bp, Zea mays
ctctcagtgcgggctccagcgtatcgaggagaagtacacctggaagctctactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagccctccagcaagtgatgcgcgacggcggccacagacctgatcgatcgatgagcgagagggagcactcggagtgtcgtgtctttatccttgccgattctttctt

SEQ ID NO: 722 - DNA, 264 bp, Zea mays
tggtcttgacatcacgccgaagatccttattgtcaccaggttgctccctgatgcaactggcaccacctgtggccagcgccttgagaaggtccttggcaccgagcactgccatatccttcgcgtgccattcagaacagaaaacggaatcgttcgcaagtggatctcgcgatttgaagtctggccgtacctggagacttacactgatgacgtggcgcatgagattgctggagagcttcaggccaatcctgacctgatcatcggaaa

SEQ ID NO: 723 - DNA, 259 bp, Zea mays
ctgggattacattcgggtgaatgtaagtgagctggctgtggaggagctgagtgtttctgagtacttggcattcaaggaacagctggtggatggacaatccaacagcaactttgtgcttgagcttgattttgagcccttcaatgcctcctttcctcgtccttccatgtcgaagtcaatcggaaatggagtgcaattccttaaccgacacctgtcgtccaagttgttccgggacaaggagagtttgtaccccttgctgaat

SEQ ID NO: 724 - DNA, 272 bp, Zea mays
cccacgcgtccgcctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcg

SEQ ID NO: 725 - DNA, 264 bp, Zea mays
gaacatgacaggcctggtcgagatgtacggcaagaacgcgcgcctgagggagctggcgaacctcgtgatcgttgccggtgaccacggcaaggagtccaaggacagggaggagcaggcggagttcaagaagatgtacagcctcatcgacgagtacaagttgaagggccatatccggtggatctcggcgcagatgaaccgcgtccgcaacggggagctgtaccgctacatttgcgatacgaagggcgcattcgtgcagcctgcgtg

SEQ ID NO: 726 - DNA, 265 bp, Zea mays
tgagaatggcatcctccgcaagtggatctctcgttttgatgtctggccatacctggagacatacactgaggatgtttccagtgaaataatgaaagaaatgcaggccaagcctgaccttatcattggcaactacagcgatggcaacctagtcgccactctgctcgcacacaagttgggagtcactcagtgtaccatcgctcatgccttggagaaaaccaaataccccaactcggacatctacttggacaagttcgacagccagtac

SEQ ID NO: 727 - DNA, 303 bp, Zea mays
acgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccgga

SEQ ID NO: 728 - DNA, 260 bp, Zea mays
caactacaaggggatgaccatgatgttgaacgacagaatccgcagtctcagtgctctgcaaggtgcgctgaggaaggctgaggagcacctgtccaccctacaagctgataccccatactctgaatttcaccacaggttccaggaacttggtctggagaagggttggggtgattgcgctaagcgtgcacaggagactatccacctcctcttggacctcctggaggccccagatccgtccaccctggagaagttccttggaa

SEQ ID NO: 729 - DNA, 258 bp, Zea mays
gtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacct

SEQ ID NO: 730 - DNA, 266 bp, Zea mays
tgcgaacgatcgcgacctgccatggtggccctgctgagatcatcgtggacggggtatctggcctgcacattgacccttaccacagcgacaaggccgcggatatcctggtcaacttctttgacaaatgcaaggcagatccgagctactgggacaagatctcacagggcggcctgcagagaatttatgagaagtacacctggaagctctactccgagaggctgatgaccctgaccggcgtgtacgggttctggaagtacgtgagcaac

SEQ ID NO: 731 - DNA, 293 bp, Zea mays
gtcgtctgcggcgaccatggcaacccttccaaggacaaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtcgggccgagatcatcgtgca

SEQ ID NO: 732 - DNA, 265 bp, Zea mays
gcgcgcctgagggagctggcgaacctcgtgatcgtcgccggtgaccacggcaaggagtccaaggacagggaggagcaggcggagttcaagaagatgtacagcctcatcgactagtacaagttgaagggccatatccggtggatctcggcgcagatgaaccgcgtccgcaacggggagctgtaccgctacatttgcgataccaagggcgcattcgtgcagcctgcgttctacgaagcgttcggcctgactgtgatcgagtccatga

SEQ ID NO: 733 - DNA, 261 bp, Zea mays
ctgagagttcctgagtacctgcagttcaaggaacagcttgtggaagaaggccccaacaacaactttgttcttgagctggactttgagccattcaatgcctccttcccccgtccttctctgtcaaagtccattggcaatggcgtgcagttcctcaacaggcacctgtcatcaaagctcttccatgacaaggagagcatgtaccccttgctcaacttccttcgcgcccacaactacaaggggatgaccatgatgttgaacgac

SEQ ID NO: 734 - DNA, 272 bp, Zea mays
aggacaccgtggggcagtacgagtcccacatcgcgttcactcttcctgggctctaccgtgtcgtccatggcatcgatgttttcgatcccaagttcaacattgtctcccctggagcagacatgagtgtttactacccgtatacggaaacgacaagagactcactgccttccatcctgaaatcgaggagctcatctacagcgacgtcgagaactccgagcacaagttcgtgctgaaggacaagaagaagccgatcatcttctcgatggcgcgtc

SEQ ID NO: 735 - DNA, 270 bp, Zea mays
atcgtgcacggcgtgtctggctaccacatcgacccttaccagggggacaaggcgtcggccctgctcgtggacttcttcgacaagtgccaggcggagcgagaccactggagcaagatctcccagggcgggctccagcgtatcgaggagaagtacacctggaagctgtattcggagaggctgatgaccctcaccggcgtgtacgggttctggaagtacgtgtccaacctggagaggcgcgagacccggcggtacctggagatgctgtacgcg

SEQ ID NO: 736 - DNA, 270 bp, Zea mays
ccctgacaccggaggccaggttgtctacatcttggatcaagtgcgcgctcatggagaacgaaatgctgctgaggatcaagcagtgtggtcttgacatcacgccgaagatccttattgtcaccaggttgctccctgatgcaactggcaccacctgtggccagcgccttgagaaggtccttggcaccggcactgccatatccttcgcgtgccattcagaacagaaaacggaatcgttcgcaagtggatctcgcgatttgaagtctggccgta

SEQ ID NO: 737 - DNA, 262 bp, Zea mays
agctcatcaacagcgacgtcgagaactccgagcacaagttcgtgctgaaggacaagaagaagccgatcatcttctcgatggcgcgtctcgaccgcgtgaagaacatgacaggcctggtggagatgtacggcaagaacgcgcgcctgagggagctggcgaacctcgtgatcgtcgccggtgaccacggcaaggagtccaaggacagggaggagcaggcggagttcaagaagatgtacagcctcatcgacgagtacaagttgaa

SEQ ID NO: 738 - DNA, 262 bp, Zea mays
aaggagtccaaggacagggaggagcaggcggagttcaagaagatgtacagcctcatcgacgagtacaagttgaagggccatatccggtggatctcggcgcagatgaaccgcgtccgcaacggggagctgtaccgctacatttgcgatacgaagggcgcattcgtgcagcctgcgttctacgaagcgttcggcctgactgtgatcgagtccatgacgtgcggtctgccaacgatcgcgacctgccatggtggccctgctgaga

SEQ ID NO: 739 - DNA, 262 bp, Zea mays
ctcgaccttctggaggcccctgatcctgccaacttggagaagttccttggaactataccaatgatgtttaacgttgttatcctgtctcctcatggctacttcgcccagtccaatgtgcttggataccctgacactggcggtcaggttgtgtacattctggatcaggtccgtgctttggagaatgagatgcttctgaggattaagcagcaaggccttgatatcactccgaagatcctcattgttaccaggctgttgcctgatg

SEQ ID NO: 740 - DNA, 264 bp, Zea mays
gaaaaccaaataccccaactcggacatctacttggacaagttcgacagccagtaccacttctcttgccagttcacagctgaccttattgccatgaaccacactgatttcatcatcaccagcacattccaagaaatcgcgggaagcaaggacaccgtggggcagtacgagtcccacatcgcgttcactcttcctgggctctaccgtgtcgtccatggcatcgatgttttcgatcccaagttcaacattgtctcccctggagcaga

SEQ ID NO: 741 - DNA, 300 bp, Zea mays
cccacgcgtccgcccacgcgtccgcccacgcgtccgatcttctcgatggcgcgtctcgaccgcgtgaagaacatgacaggcctggtggagatgtacggcaagaacgcgcgcctgaaggagctggcgaacctcgtgatcgtcgccggtgaccacggcaaggagtccaaggacagggaggagcaggcggagttcaagaagatgtacagcctcatcgacgagtacaagttgaagggccatatccggtggatctcggcgcagatgaaccgcgtccgcaacggggagctgtaccgctacatttgc

SEQ ID NO: 742 - DNA, 278 bp, Zea mays
tgcaattccttaaccgacacctgtcgtccaagttgttccaggacaaggagagtttgtaccccttgctgaacttcctcaaggctcataactacaagggcacgacgatgatgttgaatgacagaatccaaagccttcgtggtctccaatcatccctgagaaaggcagaggagtatctactgagtgttcctcaagacactccctactcggagttcaaccataggttccaagagcttggcttggagaagggttggggtgacactgcgaacgtgtactcgaca

SEQ ID NO: 743 - DNA, 315 bp, Zea mays
  unsure (1)..(315): unsure at all n locations
acctggagaggcgcgagacccggcggtacctggagatgctgtacgcgctcaagtaccgcaccatggcgagacaccgtgccgctggccgtggacggagagccctccagcaagtgatgcgcgacggcggccacagacctgatcgatcgatgagcgagagggagcactcggagtgtcgtgtcttttcccttgccatttctttctttttttcccttcccggaggcgaaaaaaagagtctgcttttgctaggcggcgggcgttcgttgctgctctttgcttcaagagttanatttacctaccttgtcaaggtcttgttcc

SEQ ID NO: 744 - DNA, 275 bp, Zea mays
atttcaccacaggttccaggaacttggtctggagaagggttggggtgattgcgctaagcgtgcacaggagactatccacctcctcttggacctcctggaggccccagatccgtccaccctggagaagttccttggaacgattcccatggttttcaatgtcgttatccgctcccctcatggttacgtcgctcaagctaatgtcttgggttaccctggcaccggaggccaggttgtctacatcttggatcaagtggcgcgctatggagaacgaaatg

SEQ ID NO: 745 - DNA, 271 bp, Zea mays
gaggagctgagtgtttctgagtacttggcattcaaggaacagctggtggatggacaatccaacagcaactttgtgcttgagcttgattttgagcccttcaatgcctcctttcctcgtccttccatgtcgaagtccatcggaaatggagtgcaattccttaaccgacacctgtcgtccaagttgttccaggacaaggagagtttgtaccccttgctgaacttcctcaaggctcataactacaagggcacgacgatgatgttgaatgacagaa

SEQ ID NO: 746 - DNA, 258 bp, Zea mays
cggaatcgttcgcaagtggatctcgcgatttgacgtctggccgtacctggagacttacactgatgacgtggcgcatgagattgctggagagcttcaggccaatcctgacctgatcatcggaaactacagtgacggaaaccttgttgcgtgtttgctcgcccacaagatgggtgttactcactgtaccattgcccatgcgcttgagaaaactaagtaccctaactccgacctctactggaagaagtttgaggatcacta

SEQ ID NO: 747 - DNA, 265 bp, Zea mays
cgccgaagatccttattgtcaccaggttgctccctgatgcaactggcaccacctgtggccagcgccttgagaaggtccttggcaccgagcactgccatatccttcgcgtgccattcagaacagaaaacggaatcgttcgcaagtggatctcgcgatttgaagtctggccgtacctggagacttacactgatgacgtggcgcatgagattgctggagagcttcaggccaatcctgacctgatcatcggaaactacagtgacggaaa

SEQ ID NO: 748 - DNA, 263 bp, Zea mays
gtcgagaactccgagcacaagttcgtgctgaaggacaagaagaagccgatcatcttctcgatggcgcgtctcgaccgcgtgaagaacatgacaggcctggtcgagatgtacggcaagaacgcgcgcctgagggagctggcgaacctcgtgatcgttgccggtgaccacggcaaggagtccaaggacagggaggagcaggcggagttcaagaagatgtacagcctcatcgacgagtacaagttgaagggccatatccggtggat

SEQ ID NO: 749 - DNA, 257 bp, Zea mays
ggacggggtatctggcctgcacattgacccttaccacagcgacaaggccgcggatatcctggtcaacttctttgacaaatgcaaggcagatccgagctactgggacaagatctcacagggcggcctgcagagaatttatgagaagtacacctggaagctctactccgagaggctgatgaccctgaccggcgtgtacgggttctggaagtacgtgagcaacctggagaggcgcgagacccgccgctacatcgagatgt

SEQ ID NO: 750 - DNA, 261 bp, Zea mays
ccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgtacgggttctggaagtacgtgtccaacctggagaggcgcgagacccggcggtacctggagatgctgtacgcgctcaagtaccgcaccatggcgaac

SEQ ID NO: 751 - DNA, 256 bp, Zea mays
ccggtgaccacggcaaggagtccaaggacagggaggagcaggcggagttcaagaagatgtacagcctcatcgacgagtacaagttgaagggccatatccggtggatctcggcgcagatgaaccgcgtccgcaacggggagctgtaccgctacatttacgataccaagggcgcattcgtgcagcctgcgttctacgaagcgttcggcctgactgtgatcgagtccatgacgtgcggtctgccaacgatcgcgacctg

SEQ ID NO: 752 - DNA, 274 bp, Zea mays
gaacgaaatgctgctgaggatcaagcagtgtggtcttgacatcacgccgaagatccttattgtcaccaggttgctccctgatgcaactggcaccacctgtggccagcgccttgagaaggtccttggcaccgagcactgccatatccttcgcgtgccattcagaacagaaaacggaatcgttcgcaagtggatctcgcgatttgaagtctggccgtacctggagacttacactgatgacgtggcgcatgagattgctggagagcttcaggccaat

SEQ ID NO: 753 - DNA, 274 bp, Zea mays
cggacggtgggtcatcggaaactacagtgacggaaaccttgttgcgtgtttgctcgcccacaagatgggtgttactcactgtaccattgcccatgcgcttgagaacactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtca

SEQ ID NO: 754 - DNA, 263 bp, Zea mays
ctggagacatacactgaggatgtttccagtgaaataatgaaagaaatgcaggccaagcctgaccttatcattggcaactacagcgatggcaagctagtcgccactctgctcgcacacaagttgggagtcactcagtgtaccatcgctcatgccttggagaaaaccaaataccccaactcggacatctacttggacaagttcgacagccagtaccacttctcttgccagttcacagctgaccttattgccatgaaccacactga

SEQ ID NO: 755 - DNA, 274 bp, Zea mays
gctcctgtacagccaaaccgagaacacggagcacaagttcgatctgaacgacaggagcaagccaatcatcttctccatggctcgtctcgaccgtgtgaagaacttgactgggctggtggagctgtacggccggaacaagcggctgcaggagctggtgtacctcgtggtcgtctgcggcgaccatggcaacccttccgaggacaaggatgatcaggccgagttcatgaagatgtttgacctcgtcgagcagtacaacctgaacgggcacatccgc

SEQ ID NO: 756 - DNA, 256 bp, Zea mays
tcgagatgtacggcaagaacgcgcgcctgagggagctggcgaacctcgtgatcgttgccggtgaccacggcaaggagtccaaggacagggaggagcaggcggagttcaagaagatgtacagcctcatcgacgagtacaagttgaagggccatatccggtggatctcggcgcagatgaaccgcgtccgcaacggggagctgtaccgctacatttgcgatacgaagggcgcattcgtgcagcctgcgttctacgaagc

SEQ ID NO: 757 - DNA, 261 bp, Zea mays
catctacagcgacgtcgagaactccgagcacaagttcgtgctgaaggacaagaagaagccgatcatcttctcgatggcgcgtctcgaccgcgtgaagaacatgacaggcctggtcgagatgtacggcaagaacgcgcgcctgagggagctggcgaacctcgtgatcgttgccggtgaccacggcaaggagtccaaggacagggaggagcaggcggagttcaagaagatgtacagcctcatcgacgagtacaagttgaaggg

SEQ ID NO: 758 - DNA, 252 bp, Zea mays
cttccttcgcgcccacaactacaaggggatgaccatgatgttgaacgacagaatccgcagtctcagtgctctgcaaggtgcgctgaggaaggctgaggagcacctgtccaccctacaagctgataccccatactctgaatttcaccacaggttccaggaacttggtctggagaagggttggggtgattgcgctaagcgtgcacaggagactatccacctcctcttggacctcctggaggccccagatccgtc

SEQ ID NO: 759 - DNA, 279 bp, Zea mays
cccacgcgtccgcccacgcgtccgccctgctcgtggacttcttcgacaagtgccaggcggagcgagccactggagcaagatctcccagggcgggctccagcgtatcgaggagaagtacacctggaagctgtactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtgga

SEQ ID NO: 760 - DNA, 254 bp, Zea mays
ggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacg

SEQ ID NO: 761 - DNA, 272 bp, Zea mays
ggagacttacactgatgacgtggcgcatgagattgctggagagcttcaggccaatcctgacctgatcatcggaaactacagtgacggaaaccttgttgcgtgtttgctcgcccacaagatgggtgttactcactgtgccagtgcgcatgcgcctgagaaaactaagtaccctaactccgacctctactggaagaagtttgaggatcactaccacttctcgtgccagttcaccactgacttgattgcaatgaaccatgccgacttcatcatca

SEQ ID NO: 762 - DNA, 287 bp, Zea mays
atcgtgcacggcgtgtctggctaccacatcgacccttaccagggcgacaaggcgtcggccctgctcgtggacttcttcgacaagtgccaggcggaccgagccactggagcaagatctcccagggcgggctccagcgtatcgaggagaagtacacctggaagctgtactcggagaggctgatgaccctcaccggcgtgtacgggttctggaagtacgtgtccaacctggagaggcgcgagacccggcggtacctggagatgctgtacgcgctcaagtaccgcaccatg

SEQ ID NO: 763 - DNA, 307 bp, Zea mays
  unsure (1)..(307): unsure at all n locations
cggacgcgtggagcgtatcgaggagaagtacacctggaagctgtactcggagaggctgatgaccctcaacggcgtgtacgggttctggaagtacgtgtccaacctggagaggcgcgagacccggcggtacctggagatgctgtacgcgctcaagtaccgcaccatggcgagcaccgtgccgctggccgtggagggagagcctccagcaagtgatgcgtgacggcggccacagacctgatcgatcgatgagcgagagggagcactcggagtgtcgtgtcttttcncttgccatttctttctttcttct

SEQ ID NO: 764 - DNA, 255 bp, Zea mays
gacaccgtggggcagtacgagtcccacatcgcgttcactcttcctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgagaactccgagcacaagttcgtgctgaaggacaagaagaagccgatcatc

SEQ ID NO: 765 - DNA, 250 bp, Zea mays
gtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaacgcgtccgcaacggcgagctgtaccgctacatctgcgacaccaagggcgccttcgtgcagcctgctttct

SEQ ID NO: 766 - DNA, 251 bp, Zea mays
gcggtctgccaacgatcgcgacctgccatggtggccctgctgagatcatcgtggacggggtatctggcctgcacattgacccttaccacagcgacaaggccgcggatatcctggtcaacttctttgacaaatgcaaggcagatccgagctactgggacaagatctcacagggcggcctgcagagaatttatgagaagtacacctggaagctctactccgagaggctgatgaccctgaccggcgtgtacggg

SEQ ID NO: 767 - DNA, 255 bp, Zea mays
gcgggaagcaaggacaccgtggggcagtacgagtcccacatcgcgttcactcttcctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgagaactccgagcacaagttcgtgctgaaggacaagaag

SEQ ID NO: 768 - DNA, 297 bp, Zea mays
cttctttgacaaatgcaaggcagatccgagctactgggacaagatctcacagggcggcctgcagagaatctatgagaagtacacctggaagctctactccgagaggctgatgaccctgaccggcgtgtacgggttctggaagtacgtgagcaacctggagaggcgcgagacccgccgctacatcgagatgttctacgccctgaagtaccgtagcctggcaagccaggttccgctgtccttcgattagtacggggaaagaagaagaagaagaagcccaggccggagaaccatcgcctg

SEQ ID NO: 769 - DNA, 265 bp, Zea mays
cccacgcgtccggatgcttctgaggattaagcagcaaggccttgatatcactccgaagatcctcattgttaccaggctgttgcctgatgctgctgggactacgtgcggtcagcggctggagaaggtcattggtactgagcacacagacatcattcgcgttcccttcagaaatgagaatggcatcctccgcaagtggatctctcgttttgatgtctggccatacctggagacatacactgaggatgtttccagtgaaataatgaaa

SEQ ID NO: 770 - DNA, 257 bp, Zea mays
caactacaaggggatgaccatgatgttgaacgacagaatccgcagtctcagtgctctgcaaggtgcgctgaggaaggctgaggagcacctgtccaccctacaagctgataccccatactctgaatttcaccacaggttccaggaacttggtctggagaagggttggggtgattgcgctaagcgtgcacaggagactatccacctcctcttggacctcctggaggccccagatccgtccacccggagaagttcttgga

SEQ ID NO: 771 - DNA, 247 bp, Zea mays
atgtaagtgagctggctgtggaggagctgagtgtttctgagtacttggcattcaaggaacagctggtggatggacaatccaacagcaactttgtgcttgagcttgattttgagcccttcaatgcctcctttcctcgtccttccatgtcgaagtccatcggaaatggagtgcaattccttaaccgacacctgtcgtccaagttgttccaggacaaggagagtttgtaccccttgctgaacttcctcaa

SEQ ID NO: 772 - DNA, 270 bp, Zea mays
cccacgcgtccgcccacgcgtccggacaaggagagcatgtaccccttgctcaacttccttcgcgcccacaactacaaggggatgaccatgatgttgaacgacagaatccgcagtctcagtgctctgcaaggtgcgctgaggaaggctgaggagcacctgtccaccctacaagctgataccccatactctgaatttcaccacaggttccaggaacttggtctggagaagggttggggtgattgcgctaagcgtgcacaggagactatccac

SEQ ID NO: 773 - DNA, 268 bp, Zea mays
cgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagca

SEQ ID NO: 774 - DNA, 246 bp, Zea mays
cctgcacattgacccttaccacagcgacaaggccgcggatatcctggtcaacttctttgacaaatgcaaggcagatccgagctactgggacaagatctcacagggcggcctgcagagaatttatgagaagtacacctggaagctctactccgagaggctgatgaccctgaccggcgtgtacgggttctggaagtacgtgagcaccctggagaggcgcgagacccgccgctacatcgagatgttcta

SEQ ID NO: 775 - DNA, 277 bp, Zea mays
acacacgcgtccgcggacgcgtgggcccatactctgaatttcaccacaggttccaggaacttggtctggagaagggttggggtgatagcgctaagcgagcacaggagactatccacctcctcttggacctcctggaggccccagatccgtccaccctggagaagttccttggaacgatccccatggtgttcaatgtcgttatcctctcccctcatggttacttcgctcaagctaatgtcttgggttaccctgacaccggaggccaggttgtctacat

SEQ ID NO: 776 - DNA, 248 bp, Zea mays
ggagaacgaaatgctgctgaggatcaagcagtgtggtcttgacatcacgccgaagatccttattgtcaccaggttgctccctgatgcaactggcaccacctgtggccagcgccttgagaaggtccttggcaccgagcactgccatatccttcgcgtgccattcagaacagaaaacggaatcgttcgcaagtggatctcgcgatttgaagtctggccgtacctggagacttacactgatgacgtggcgc

SEQ ID NO: 777 - DNA, 251 bp, Zea mays
ccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacagg

SEQ ID NO: 778 - DNA, 283 bp, Zea mays
ggcggcgggcgttcgttgctgctctttgcttcaagagttaaatttacctaccttgtcaaggtcttgttccatcattgatccgggtgtcgcttttagtagtctgatggactgttagtagtttgcgttgcgtcggttgagagggaacggtggtggtggtggtgtgtgtgcagtcgggtgtggtgctccctttgtttcctggatgggatgttgctccttgaataataatcgtagtggccttggagcccttttcctgaaataagagcagcatcctagtgcttcactt

SEQ ID NO: 779 - DNA, 288 bp, Zea mays
gtgacggaaaccttgttgcgtgtttgctcgcccacaagatgggtgttactcactgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtcc

SEQ ID NO: 780 - DNA, 244 bp, Zea mays
ccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttc

SEQ ID NO: 781 - DNA, 247 bp, Zea mays
acggcaaggagtccaaggacagggaggagcaggcggagttcaagaagatgtacagcctcatcgacgagtacaagttgaagggccatatccggtggatctcggcgcagatgaaccgcgtccgcaacggggagctgtaccgctacatttgcgataccaagggcgcattcgtgcagcctgcgttctacgaagcgttcggcctgactgtgatcgagtccatgacgtgcggtctgccaacgatcgcgacctg

SEQ ID NO: 782 - DNA, 261 bp, Zea mays
tgcgttctacgaagcgttcggcctgactgtgatcgagtccatgacgtgcggtctgccaacgatcgcgacctgccatggtggccctgctgagatcatcgtggacggggtatctggcctgcacattgacccttaccacagcgacaaggccgcggatatcctggtcaacttctttgacaaatgcaaggcagatccgagctactgggacaagatctcacagggcggcctgcagagaatttatgagaagtacacctggaagctcta

SEQ ID NO: 783 - DNA, 257 bp, Zea mays
ccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccga

SEQ ID NO: 784 - DNA, 251 bp, Zea mays
gacaagaagaagccgatcatcttctcgatggcgcgtctcgaccgcgtgaagaacatgacaggcctggtggagatgtacggcaagaacgcgcgcctgagggagctggcgaacctcgtgatcgtcgccggtgaccacggcaaggagtccaaggacagggaggagcaggcggagttcaagaagatgtacagcctcatcgacgagtacaagttgaagggccatatccggtggatctcggcgcagatgaaccgcgt

SEQ ID NO: 785 - DNA, 290 bp, Zea mays
ggaagtacgtgagcaacctggagaggcgcgagacccgccgctacatcgagatgttctacgccctgaagtaccgtagcctggcaagccaggttccgctgtccttcgattagtacggggaaagaagaagaagaagaagcccaggccgctattttatcgcctgcatttcgatctgtttcaccgcaattcgcattgttagtcgtgtattggagttatgtgtacttggtttccaagaactttagttccttctcgttttttttccttgtttgagcgtttttgggcagcgctggcct

SEQ ID NO: 786 - DNA, 311 bp, Zea mays
cggacgcgtggcgcgacgcgtgggctgccaacttggagaagttccttggaactataccaatgatgttcaatgttgttatccttactcctcatggcagatttcgctcagtccaatgtgcttggataccctgacactggcggtcaggttgtgtacattctggatcaagtccgtgctttggagaatgagatgcttctgaggattaagcagcaaggccttgatatcactccgaagatcctcattgttaccaggctgttgcctgatgctgctgggactacgtgcggtcagcggctggagaaggtcattggtactga

SEQ ID NO: 787 - DNA, 258 bp, Zea mays
cttgattttgagcccttcaatgcctcctttcctcgtccttccatgtcgaagtccatcggaaatggagtgcaattccttaaccgacacctgtcgtccaagttgttccaggacaaggagagtttgtaccccttgctgaacttcctcaaggctcataactacaagggcacgacgatgatgttgaatgacagaatccaaagccttcgtggtctccaatcatccctgagaaaggcagaggagtatctactgagtgttcctcaa

SEQ ID NO: 788 - DNA, 244 bp, Zea mays
atgagtgtttactacccgtatacggaaaccgacaagagactcactgccttccatcctgaaatcgaggagctcatctacagcgacgtcgagaactccgagcacaagttcgtgctgaaggacaagaagaagccgatcatcttctcgatggcgcgtctcgaccgcgtgaagaacatgacaggcctggtcgagatgtacggcaagaacgcgcgcctgagggagctggcgaacctcgtgatcgttgccg

SEQ ID NO: 789 - DNA, 270 bp, Zea mays
cggacgcgtgggcggacgcgtgggtgcggcgaccatggcaacccttccaaggacaaggaggagcaggccgagttcaagaagatgtatgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacg

SEQ ID NO: 790 - DNA, 274 bp, Zea mays
  unsure (1)..(274): unsure at all n locations
ggtacctggagatgctgtacgcgctcaagtaccgcaccatggcgagcaccgtgccgctggccgtggagggagagccctccagcaagtgatgcgtgacggcggccacagacctgatcgatcgatgagcgagagggagcactcggagtgtcgtgtcttttcccttgccannnnnnnnnnnnnnnnnnntccttcccggaggcgaaaaaaaaagagtctgcttttgctaggcggcgggcgttcgttgctgctctttgcttcaagagttaaatttacc

SEQ ID NO: 791 - DNA, 256 bp, Zea mays
cccacgcgtccggccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaa

SEQ ID NO: 792 - DNA, 287 bp, Zea mays
tgcggtacctggagatgctgtacgcgctcaagtaccgcaccatggcgagcaccgtgccgctggccgtggagggagagccctccagcaagtgatgcgtgacggcggccacagacctgatcgatcgatgagcgagagggagcactcggagtgtcgtgtcttttcccttgccatttctttctttcttctttttccttcccggaggcgaaaaaaaaagagtctgcttttgctaggcggcgggcgttcgttgctgctctttgcttcaagagttaaatttacctaccttgtca

SEQ ID NO: 793 - DNA, 244 bp, Zea mays
caccgagcactgccatatccttcgcgtgccattcagaacagaaaacggaatcgttcgcaagtggatctcgcgatttgaagtctggccgtacctggagacttacactgatgacgtggcgcatgagattgctggagagcttcaggccaatcctgacctgatcatcggaaactacagtgacggaaaccttgttgcgtgtttgctcgcccacaagatgggtgttactcactgtaccattgcccatgcg

SEQ ID NO: 794 - DNA, 244 bp, Zea mays
caccacctgtggccagcgccttgagaaggtccttggcaccgagcactgccatatccttcgcgtgccattcagaacagaaaacggaatcgttcgcaagtggatctcgcgatttgaagtctggccgtacctggagacttacactgatgacgtggcgcatgagattgctggagagcttcaggccaatcctgacctgatcatcggaaactacagtgacggaaaccttgttgcgtgtttgctcgcccac

SEQ ID NO: 795 - DNA, 282 bp, Zea mays
  unsure (1)..(282): unsure at all n locations
cactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcctttcnccggggtttnggggncctttaatncnnncgnggnntgng

SEQ ID NO: 796 - DNA, 249 bp, Zea mays
gacaagaagaagccgatcatcttctcgatggcgcgtctcgaccgcgtgaagaacatgacaggcctggtggagatgtacggcaagaacgcgcgcctgagggagctggcgaacctcgtgatcgtcgccggtgaccacggcaaggagtccaaggacagggaggagcaggcggagttcaagaagatgtacagcctcatcgacgagtacaagttgaagggccatatccggtggatctcggcgcagatgaaccgc

SEQ ID NO: 797 - DNA, 248 bp, Zea mays
gttatcctttctcctcatggctacttcgctcagtccaatgtgcttggataccctgacactggcggtcaggttgtgtacattctggatcaagtccgtgctttggagaatgagatgcttctgaggattaagcagcaaggccttgatatcactccgaagatcctcattgttaccaggctgttgcctgatgctgctgggactacgtgcggtcagcggctggagaaggtcattggtactgagcacacagacat

SEQ ID NO: 798 - DNA, 295 bp, Zea mays
ggcgagctgtaccgctacatctgcgacaccaaggccgccttcgtgcagcctgctttctacgaggctttcgggctgacggtggttgaggccatgacctgcggcctgcccacgtttgccacagcctacggcggtccggccgagatcatcgtgcacggcgtgtcggctaccacatcgacccttaccagggcgacaaggcgtcggccctgctcgtggacttcttcgacaagtgccaggcggacccgagccactggagcaagatctcccagggcgggctccagcgtatcgaggagaagta

SEQ ID NO: 799 - DNA, 255 bp, Zea mays
  unsure (1)..(255): unsure at all n locations
anagatgtttgacctcatcgagcagtacaacctgaacgggcacatccgctggatcnccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgttcgccaccgcctacggcgtccggccgagatcatcgtgcacggcgtgtctggctaccacatc

SEQ ID NO: 800 - DNA, 244 bp, Zea mays
cctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgac

SEQ ID NO: 801 - DNA, 238 bp, Zea mays
gtttgctcgcccacaagatgggtgttactcactgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgtt

SEQ ID NO: 802 - DNA, 256 bp, Zea mays
ggaccgggccttaccagggcgacaaggcgtcggccctgctcgtggacttcttcgacaagtactcaggcggacccgagccactggagcaagatctcccagggcgggctccagcgtatcgaggagaagtacacctggaagctctactcggagaggctgatgaccctcaccggcgtgtacgggttctggaagtacgtgtccaacctggagaggcgcgagacccggcggtacctggagatgctgtacgcgctcaagtacc

SEQ ID NO: 803 - DNA, 252 bp, Zea mays
aacctagtcgccactctgctcgcgcacaagttgggagtcactcagtgtaccatcgctcatgccttggagaaaaccaaataccccaactcggacatatacttggacaaattcgacagccagtaccacttctcttgccagttccagctgaccttattgccatgaaccacaccgatttcatcatcaccagcacattccatgaaatcgcgggaagcaaggacaccgtggggcagtacgagtcccacatcgcgttca

SEQ ID NO: 804 - DNA, 287 bp, Zea mays
atgcatgctcgcgcacaagatgggtgttactcactgtaccattgcccatgcgcttgagaaaactaagtaccctaactccgacctctactggaagaagtttgaggatcactaccacatctcgtgccagttcaccactgacttgattgcaatgaaccatgccgacttcatcatcaccagtaccttccagagatcgccggtaacaaggacaccgtcggccagtacgagtcacacatggcgttcacaatgcctggactgtaccgcgttgtcgacggcattgatgtgttcga

SEQ ID NO: 805 - DNA, 287 bp, Zea mays
ggacgctgggaaaaaaaagagtctgcttttgctaggcggcgggcgttcgttgctgctctttgattcaagagttaaatttacctaccttgtcaaggtcttgttccatcattgatccgggtgtcgcttttagtagtctgatggactgttagtagtttgcgttgcgtcggttgagagggaacggtggtggtggtggtgtgtgtgcagtcgggtgtggtgctccctttgtttcctggatgggatgttgctccttgaataataatcgtagtggccttggagcccttttcctg

SEQ ID NO: 806 - DNA, 276 bp, Zea mays
gtctgcttttgctaggcggcgggcgttcgttgctgctctttgcttcaagagttaaatttacctaccttgtcaaggtcttgttccatcattgatccgggtgtcgcttttagtagtctgatggactgttagtagtttgcgttgcgtcggttgagagggaacggtggtggtggtggtgtgtgtgcagtcgggtgtggtgctccctttgtttcctggatgggatgttgctccttgaataataatcgtagtggccttggagcccttttcctgaaataagag

SEQ ID NO: 807 - DNA, 254 bp, Zea mays
gacccggcggtacctggagatgctgtacgcgctcaagtaccgcaacatggcgagcacagtgccgctggccgtggagggagagccctccagcaagtgatgcgtgacggcggccacagacctgatcgatcgatgagcgagagggagcactcggagtgtcgtgtcttttcccttgccattactttctttcttctttttccttcccggaggcgaaaaaaaaagagtctgcttttgctaggcggcgggcgttcgttgct

SEQ ID NO: 808 - DNA, 321 bp, Zea mays
acggaccgccagggtccgcgacctgcgagtggctacggaggccgaggttgtctacatcttggatcaagtgcgcgctatggagagccgaaatgctgctgaggatcaagcagtgtggtcttgacatcacgccgaagatccttattgtcaccaggttgctccctgatgcaactggcaccacctgtggccagcgccttgagaaggtccttggcaccgagcactgccatatccttcgcgtgccatgtcagaacagaaaacggaatcgttcgcaagtggatctcgcgatttgaagtcgtgccgtacctggagacttacactgatgac

SEQ ID NO: 809 - DNA, 273 bp, Zea mays
acgggttctggaagtacgtgtccaacctggagaggcgcgagacccggcggtacctggagatgctgtacgcgctcaagtaccgcaccatggcgagcaccgtgccgctggccgtggagggagagccctccagcaagtgatgcgcgacggcggccacagacctgatcgatcgatgagcgagatggagcactcggagtgtcgtgtcttttcccttgccatttctttctttttttcccttcccggaggcgaaaaaaagagtctgcttttgctaggcgg

SEQ ID NO: 810 - DNA, 241 bp, Zea mays
gatcgagtccatgacgtgcggtctgccaacgatcgcgacctgccatggtggccctgctgagatcatcgtggacggggtatctggcctgcacattgacccttaccacagcgacaaggccgcggatatcctggtcaacttctttgacaaatgcaaggcagatccgagctactgggacaagatctcacagggcggcctgcagagaatttatgagaagtacacctggaagctctactccgagagg

SEQ ID NO: 811 - DNA, 235 bp, Zea mays
acggaaaccgacaagagactcactgccttccatcctgaaatcgaggagctcatctacagcgacgtcgagaactccgagcacaagttcgtgctgaaggacaagaagaagccgatcatcttctcgatggcgcgtctcgaccgcgtgaagaacatgacaggcctggtcgagatgtacggcaagaacgcgcgcctgagggagctggcgaacctcgtgatcgttgccggtgaccacggca

SEQ ID NO: 812 - DNA, 242 bp, Zea mays
tgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctc

SEQ ID NO: 813 - DNA, 240 bp, Zea mays
gggcgcattcgtgcagcctgcgttctacgaagcgttcggcctgactgtgatcgagtccatgacgtgcggtctgccaacgatcgcgacctgccatggtggccctgctgagatcatcgtggacggggtatctggcctgcacattgacccttaccacagcgacaaggccgcggatatcctggtcaacttctttgacaaatgcaaggcagatccgagctactgggacaagatctcacagggcgg

SEQ ID NO: 814 - DNA, 244 bp, Zea mays
ggtggatctcggcgcagatgaaccgcgtccgcaacggggagctgtaccgctacatttgcgatacgaagggcgcattcgtgcagcctgcgttctacgaagcgttcggcctgactgtgatcgagtccatgacgtgcggtctgccaacgatcgcgacctgccatggtggccctgctgagatcatcgtggacggggtatctggcctgcacattgacccttaccacagcgacaaggccgcggatatcct

SEQ ID NO: 815 - DNA, 237 bp, Zea mays
caggccaatcctgacctgatcatcggaaactacagtgacggaaaccttgttgcgtgtttgctcgcccacaagatgggtgttactcactgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtaccttc

SEQ ID NO: 816 - DNA, 239 bp, Zea mays
gctacttcgcccagtccaatgtgcttggataccctgacactggcggtcaggttgtgtacattctggatcaggtccgtgctttggagaatgagatgcttctgaggattaagcagcaaggccttgatatcactccgaagatcctcattgttaccaggctgttgcctgatgctgctgggactacgtgcggtcagcggctggagaaggtcattggtactgagcacacagacatcattcgcgtt

SEQ ID NO: 817 - DNA, 263 bp, Zea mays
acaagcctgaccttatcattggcaactacagcgatggcaacctagtcgccactctgctcgcacacaagttgggagtcactcagtgtaccatcgctcatgccttggagaaaaccaaataccccaactcggacatctacttggacaagttcgacagccagtaccacttctcttgccagttcacatgtgaccttattgccatgaaccacactgatttcatcatcaccagcacatccctcaaattcgcgggaagcaaggacaccgtg

SEQ ID NO: 818 - DNA, 271 bp, Zea mays
aaaagagtctgcttttgctaggcggcgggcgttcgttgctgctctttgcttcaagagttaaatttacctaccttgtcaaggtcttgttccatcattgatccgggtgtcgcttttagtagtctgatggactgttagtagtttgcgttgcgtcggttgagagggaacggtggtggtggtggtgtgtgtgcagtcgggtgtggtgctccctttgtttcctggatgggatgttgctccttgaataataatcgtagtggccttggagcccttttcc

SEQ ID NO: 819 - DNA, 366 bp, Zea mays
agcttatctagcttagctaagtcggaattcgagtcgagcctaagttcaacattgtctctcctggagcagacatgtagtgtttatcatcttatacggtaatcgataagagactcactgagtttcaacctgacatcgagaacgtcatcaacagcgacgtcgagaactccgagcacaagttcgtgctgaatgacaagaagaatccgatcatcttctcgatgtcgcgtctcgaccgcgtgaagaacatgtcaggcctggtggagatgtacggcaagaacgcgcgcctgagggagctggcgaacctcgtgatcgtcgccggtgaccacggcaaggagtccatagacagggaggagcaggcggagttcaaga

SEQ ID NO: 820 - DNA, 211 bp, Zea mays
agggtatctggcctgcacattgacccttaccacagcgacaaggccgcggatatcctggtcaacttctttgacaaatgcaaggcagatccgagctactgggacaagatctcacagggcggcctgcagagaatctatgagaagtacacctggaagctctactccgagaggctgatgaccctgaccggcgtgtacgggttctggaagtacgtga

SEQ ID NO: 821 - DNA, 246 bp, Zea mays
gtccttccatgtcgaagtccatcggaaatggagtgcaattccttaaccgacacctgtcgtccaagttgttccaggacaaggagagtttgtaccccttgctgaacttcctcaaggctcataactacaagggcacgacgatgatgttgaatgacagaatccaaagccttcgtggtctccaatcatccctgagaaaggcagaggagtatctactgagtgttcctcaagacactccctactcggagttca

SEQ ID NO: 822 - DNA, 237 bp, Zea mays
cgagtacaagttgaagggccatatccggtggatctcggcgcagatgaaccgcgtccgcaacggggagctgtaccgctacatttgcgatacgaagggcgcattcgtgcagcctgcgttctacgaagcgttcggcctgactgtgatcgagtccatgacgtgcggtctgccaacgatcgcgacctgccatggtggccctgctgagatcatcgtggacggggtatctggcctgcacattga

SEQ ID NO: 823 - DNA, 236 bp, Zea mays
gtgacggaaaccttgttgcgtgtttgctcgcccacaagatgggtgttactcactgtaccattgcccatgcgcttgagaaaactaagtaccctaactccgacctctactggaagaagtttgaggatcactaccacttctcgtgccagttcatcactgacttgattgcaatgaaccatgccgacttcatcatcaccagtaccttccaagagatcgccggaaacaaggacaccgtcggc

SEQ ID NO: 824 - DNA, 273 bp, Zea mays
gaagggttggggtgacactgcgaacgtgtactcgacacactccacttgcttctcgaccttctggaggcccctgatcctgccaacttggagaagttccttggaactataccaatgatgttcaacgttgttatcctgtctcctcatggctacttcgcccagtccaatgtgcttggataccctgacactggcggtcaggttgtgtacattctggatcaggtccgtgccttggagaatgagatgcttctgaggattaagcagcagggcctgatatca

SEQ ID NO: 825 - DNA, 245 bp, Zea mays
cgcaactacagcgatggcaacctagtcgccactctgctcgcacacaagttgggagtcactcagtgtaccatcgctcatgccttggagaaaaccagataccccaactcggacatctacttggacaagttcgacagccagtaccacttctcttgccagttcacagctgaccttattgccatgaaccacactgatttcatcatcaccagcacattccaagaaatcgcgggaagcaaggacaccgtggg

SEQ ID NO: 826 - DNA, 232 bp, Zea mays
ccaccctacaagctgataccccatactctgaatttcaccacaggttccaggaacttggtctggagaagggttggggtgattgcgctaagcgtgcacaggagactatccacctcctcttggacctcctggaggccccagatccgtccaccctggagaagttccttggaacgatccccatggtgttcaatgtcgttatcctctcccctcatggttacttcgctcaagctaatgt

SEQ ID NO: 827 - DNA, 238 bp, Zea mays
gcgtgtacgggttctggaagtacgtgtccaacctggagaggcgcgagacccggcggtacctggagatgctgtacgcgctcaagtaccgcaccatggcgagcaccgtgccgctggccgtggagggagagccctccagcgagtgatgcgtgacggcggccacagacctgatcgagcgatgagcgagagggagcactcggagtgtcgtgtctttgcccttgccatttctttctttcttctt

SEQ ID NO: 828 - DNA, 255 bp, Zea mays
  unsure (1)..(255): unsure at all n locations
ggcgagctgtaccgctacatctgcgacaccaagggcgccttcgtgcagcctgctttctacgaggctttcgggctgacggtggttgaggccatgacctgcggcctgcccacgttcgccaccgcctacggcgntccggccgagatcatcgtgcacggcgtgtctggctaccacatcgacccttaccagggcgacaaggcgtcggccctgctcgtggacttcttcgacaagtgccaggcggagctgagccactggagc

SEQ ID NO: 829 - DNA, 271 bp, Zea mays
ggttcgcgtgccattcagaacagaaaacggaatcgttcgcaagtggatctcgcgatttgaagtctggccgtacctggagacttacactgatgacgtggcgcatgagattgctggagagcttcaggccaatcctgacctgatcatccggaaactacagtgacggaaaccttgttgcgtgtttgctcgcccacaagatgggtgttactcactgtaccattgcccatgcgcttgagaaaactaagtaccctaactccgacctctactggacgaa

SEQ ID NO: 830 - DNA, 260 bp, Zea mays
gagctgtaccgctacatttgcgataccaagggcgcattcgtgcagcctgcgttctacgaagcgttcggcctgactgtgatcgagtccatgacgtgcggtctgccaacgatcgcgatctgccatggtggccctgctgagatcatcgtggacggggtatctggcctgcacattgacccttaccacagcgacaaggccgcggatatcctggtcaacttctttgacaaatgcaaggcagatccgagctactgggacaagatctc

SEQ ID NO: 831 - DNA, 272 bp, Zea mays
ctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagccctccagcaagtgatgcgcgacggcggccacagacctgatcgatcgatgagcgagagggagcactcggagtgtcgtgtcttttcgcttgccatttctttcttttattcgcttcgcggaggcgaagaaaagagtctg

SEQ ID NO: 832 - DNA, 252 bp, Zea mays
cccacgcgtccgcccacgcgtccgctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacac

SEQ ID NO: 833 - DNA, 232 bp, Zea mays
atcgcgacctgccatggtggccctgctgagatcatcgtggacggggtatctggcctgcacattgacccttaccacagcgacaaggccgcggatatcctggtcaacttctttgacaaatgcaaggcagatccgagctactgggacaagatctcacagggcggcctgcagagaatttatgagaagtacacctggaagctctactccgagaggctgatgaccctgaccggcgtgt

SEQ ID NO: 834 - DNA, 238 bp, Zea mays
gcacgaggcggacccgagccactggagcaagatctcccagggcgggctccagcgtatcgaggagaagtacacctggaagctctactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggagggagag

SEQ ID NO: 835 - DNA, 272 bp, Zea mays
cggacgcgtggtggcgcatgagattgctggagagcttcaggccaatcctgacctgatcatcggaaactacacgtgacggaaaccttgttgcgtgtttgctcgcccacaagatgggtgttactcactgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtacc

SEQ ID NO: 836 - DNA, 262 bp, Zea mays
tccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaaatgccaggcggacccgagccaatggag

SEQ ID NO: 837 - DNA, 313 bp, Zea mays
cgagatgttctacgccctgaagtaccgtagcctggcaagccaggttccgctgtccttcgattagtacggggaaagaagaagaagaagaagcccaggccggagaaccatcgcctgcatttcgatctgtttcaccgcaattcgcattgttagtcgtgtattggagttatgtgtacttggtttccaagaactttggttccttgtatttatatctttcttgtatgaacgtttttaggcagcgctggcctggttcctagtatggtgagaattggctgcaccttttgcttcgaataaaaatgcctgctcgttcacctgt

SEQ ID NO: 838 - DNA, 225 bp, Zea mays
ggcgaacctcgtgatcgttgccggtgaccacggcaaggagtccaaggacagggaggagcaggcggagttcaagaagatgtacagcctcatcgacgagtacaagttgaagggccatatccggtggatctcggcgcagatgaaccgcgtccgcaacggggagctgtaccgctacatttgcgatacgaagggcgcattcgtgcagcctgcgttctacgaagcgttcgg

SEQ ID NO: 839 - DNA, 241 bp, Zea mays
ggagtatctactgagtgttcctcaagacactccctactcggagttcaaccataggttccaagagcttggcttggagaagggttggggtgacactgcgaacgtgtaactcgacacactccacttgcttctcgaccttctggaggcccctgatcctgccaacttggagaagttccttggaactataccaatgatgttcaacgttgttatcctgtctcctcatggctacttcgcccagtccaat

SEQ ID NO: 840 - DNA, 235 bp, Zea mays
gcacgaggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagt

SEQ ID NO: 841 - DNA, 226 bp, Zea mays
gaggatcaagcagtgtggtcttgacatcacgccgaagatccttattgtcaccaggttgctccctgatgcaactggcaccacctgtggccagcgccttgagaaggtccttggcaccgagcactgccatatccttcgcgtgccattcagaacagaaaacggaatcgttcgcaagtggatctcgcgatttgaagtctggccgtacctggagacttacactgatgacgtg

SEQ ID NO: 842 - DNA, 227 bp, Zea mays
ggagcacctgtccaccctacaagctgataccccatactctgaatttcaccacaggttccaggaacttggtctggagaagggttggggtgattgcgctaagcgtgcacaggagactatccacctcctcttggacctcctggaggccccagatccgtccaccctggagaagttccttggaacgatccccatggtgttcaatgtcgttatcctctcccctcatggttact

SEQ ID NO: 843 - DNA, 226 bp, Zea mays
gcccacaagatgggtgttactcactgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatgg

SEQ ID NO: 844 - DNA, 237 bp, Zea mays
cagaatccaaagccttcgtggtctccaatcatccctgagaaaggcagaggagtatctactgagtgttcctcaagacactccctactcggagttcaaccataggttccaagagcttggcttggagaagggttggggtgacactgcgaacgtgtactcgacacactccacttgcttctcgaccttctggaggcccctgatcctgccaacttggagaagttccttggaactataccaatg

SEQ ID NO: 845 - DNA, 234 bp, Zea mays
ggcgaacctcgtgatcgttgccggtgaccacggcaaggagtccaaggacagggaggagcaggcggagttcaagaagatgtacagcctcatcgacgagtacaagttgaagggccatatccggtggatctcggcgcagatgaaccgcgtccgcaacggggagctgtaccgctacatttgcgatacgaagggcgcattcgtgcagcctgcgttctacgaagcgttcggcctgactgt

SEQ ID NO: 846 - DNA, 243 bp, Zea mays
atccggtggatctcggcgcagatgaaccgcgtccgcaacggggagctgtaccgctacatttgcgatacgaacggcgcattcgtgcagcctgcgttctacgaagcgttcggcctgactgtgatcgagtccatgacgtgcggtctgccaacgatcgcgacctgccatggtggccctgctgagatcatcgtggacggggtatctggcctgcacattgacccttaccacagcgacaaggccgcggat

SEQ ID NO: 847 - DNA, 238 bp, Zea mays
  unsure (1)..(238): unsure at all n locations
gcgttgtccacggcattgatgtgttcgaccccaaagttcaacatcgtgtctcctggcncggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaattgaa

SEQ ID NO: 848 - DNA, 228 bp, Zea mays
ggcaacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgtacgggttctggaagtacgtgtccaacctggag

SEQ ID NO: 849 - DNA, 217 bp, Zea mays
cgatcatcttctcgatggcgcgtctcgaccgcgtgaagaacatgacaggcctggtcgagatgtacggcaagaacgcgcgcctgagggagctggcgaacctcgtgatcgttgccggtgaccacggcaaggagtccaaggacagggaggagcaggcggagttcaagaagatgtacagcctcatcgacgagtacaagttgaagggccatatccggtggat

SEQ ID NO: 850 - DNA, 236 bp, Zea mays
cccacgcgtccgctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggcttt

SEQ ID NO: 851 - DNA, 222 bp, Zea mays
caagcggctgcaggagctggtgaacctcgtggtcgtctgcggcgaccctggcaacccttccaaggacaaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcc

SEQ ID NO: 852 - DNA, 224 bp, Zea mays
cccttccaaggacaaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgc

SEQ ID NO: 853 - DNA, 265 bp, Zea mays
cgtgtctcctggcgcggacctgtccatctacttcccgtacaccgagtcgcacaagaggctgacctcccttcacccggagattgaggagctcctgtacagcacacggagcacaagttcgttctgaacgacaggaacaagccaatcatcttctccatggctcgtctcgaccgtgtgaagaacttgactgggctggtggagctgtacggccggaacaagcggctgcaggagctggtgaactcgtggtcgtctcgagcgacatggcaac

SEQ ID NO: 854 - DNA, 260 bp, Zea mays
gtacgccttgctcaacttccttcgcgcccacaactacaaggggatgaccatgatgttgaacgacagaatccgcagtctcagtgctctgcaaggtgcgctgaggaaggctgaggagcacctgtccaccctacaagctgataccccatactctgaatttcaccacaggttccaggaacttggtctggagaagggttggggtgattgcgctaagcgtgcacaggagactatccacctcctcttggacctcctggaggccccag

SEQ ID NO: 855 - DNA, 260 bp, Zea mays
ggacctggtgaccctcaccggcgtgtacgggttctggaagtacgtgtccaacctggagaggcgagcgacccggcggtacctggagatgctgtacgcgctcaagtaccgcaccatggcgagcaccgtgccgctggccgtggagggagagccctccagcaagtgatgcgtgacggcggccacagacctgatcgatcgatgagcgagagggagcactcggagtgtcgtgtcttttcccttgccatttctttctttcttctttt

SEQ ID NO: 856 - DNA, 266 bp, Zea mays
tggtgacactgcgaaggtgtactcgacacactcaacttgcttcttgaccttcttgaggcccctgatcctgccaacttggagaagttccttggaactataccaatgatgttcaatgttgttatcctttctcctcatggctacttcgctcagtccaatgtgcttggataccctgacactggcggtcaggttgtgtacattctggatcaagtccgtgctttggagaatgagatgcttctgaggattaagcagcaagccttgatatcact

SEQ ID NO: 857 - DNA, 233 bp, Zea mays
gcacgaggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagat

SEQ ID NO: 858 - DNA, 225 bp, Zea mays
ccaagttcaacatcgggtctcctggcacggacctgtccatctacttcccgtacaccgagtcgcacaagatgctgacctcccttcagccggagatttacgagctcctgtacaggcaaaccgagaacacggagcacaagttcgttctgaacgacagggacaagccaatcatcttctccatggctcgtctcgaccgtgtgaagaactttactgggctggtggagctgt

SEQ ID NO: 859 - DNA, 275 bp, Zea mays
gcggcgggtctcgcgccgctacatcgagatgttctacgccctgaagtaccgtagcctggcaagccaggttccgctgtccttcgattagtacggggaaagaagaagaagaagaagcccaggccggagaaccatcgcctgcaagtcgatctgtttcaccgcaattcgcattgttagtcgtgtattggagttatgtgtacttggtttccaagaactttggttccttgtttttttttctttcttgtttgagcggttttgggcagcgctggcctggttcc

SEQ ID NO: 860 - DNA, 267 bp, Zea mays
cggacgcgtgggcggacgcgtgggcggacgcgtgggttggaactataccaatgatgttcaacgttgttatcctgtctcctcatggctacttcgaccagtccaatgtgcttggataccctgacactggcggtcaggttgtgtacattctggatcaggtccgtgctttggagaatgagatgcttctgaggattaagcagcaaggccttgatatcactccgaagatcctcattgttaccaggctgttgcctgatgctgctgggactacgt

SEQ ID NO: 861 - DNA, 228 bp, Zea mays
gcacgagccaacctggagaggcgcgagacccggcggtacctggagatgctgtacgcgctcaagtaccgcaccatggcgagcaccgtgccgctggccgtggagggagagccctccagcaagtgatgcgcgacggcggccacagacctgatcgatcgatgagcgagagggagcactcggagtgtcgtgtcttttcccttgccatttctttctttttttcccttcccggag

SEQ ID NO: 862 - DNA, 247 bp, Zea mays
cggagatccagcggatgtgcccgttcaggtgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcg

SEQ ID NO: 863 - DNA, 219 bp, Zea mays
actcactgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatg

SEQ ID NO: 864 - DNA, 229 bp, Zea mays
cttggataccctgacactggcggtcaggttgtgtacattctggatcaggtccgtgctttggagaatgagatgcttctgaggattaagcagcaaggccttgatatcactccgaagatcctcattgttaccaggctgttgcctgatgctgctgggactacgtgcggtcagcggctggagaaggtcattggtactgagcacacagacatcattcgcgttcccttcagaaatg

SEQ ID NO: 865 - DNA, 239 bp, Zea mays
cggaccgtggctcaacaggcacctgtcatcaaagctcttccatgacaaggagagcatgtaccccttgctcgacttccttcgcgcccacaactacaaggggatgaccatgatgttgaacgacagaatccgcagtctcagtgctctgcaaggtgcgctgaggaaggctgaggagcacctgtccaccctacaagctgataccccatactctgaatttcaccacaggttccaggaacttggtc

SEQ ID NO: 866 - DNA, 259 bp, Zea mays
tgctcgagccgaatcggctcgagcttcagaaatgagaatggcatcctccgcaagtggatctctacttttgatgtctggccatagctggagacatacactgaggatgtttccagtgaaataatgaaagatatgcaggccaagcctgaccttatcattggcaactacagcgatggcaacccggtcgccactctgctcgcgcacaagttgggagtcactcagtgtaccatcgctcatgccttggagaaaaccaaatacccca

SEQ ID NO: 867 - DNA, 222 bp, Zea mays
ccaggccggagaaccatcgcctgcatttcgatctgtttcaccgcaattcgcattgttagtcgtgtattggagttatgtgtacttggtttccaagaactttggttccttctcgttttttttccttgtttgagagtttttgggcagcgctggcctggttcctagtatggtgggaattggctgcaccttttgcttcgaataaaaatgcctgctcgttcacctgtc

SEQ ID NO: 868 - DNA, 220 bp, Zea mays
ctgggacaagatctcacagggcggcctgcagagaatctatgagaagtacacctggaagctctactccgagaggctgatgaccctgaccggcgtgtacgggttctggaagtacgtgagcaacctggagaggcgcgagacccgccgctacatcgagatgttctacgccctgaagtaccgtagcctggcaagccaggttccgctgtccttcgattagtacggg

SEQ ID NO: 869 - DNA, 235 bp, Zea mays
cagacgctgggcgaccgcgtgaagaacatgacaggcctggtggagatgtacggcaagaacgcgcgcctgagggagctggcgaacctcgtgatcgtcgccggtgaccacggcaaggagtccaaggacagggaggagcaggcggagttcaagaagatgtacagcctcatcgacgagtacaagttgaagggccatatccggtggatctcggcgcagatgaaccgcgtccgcaacgggg

SEQ ID NO: 870 - DNA, 259 bp, Zea mays
tgagaatggcatcctccgcaagtggatctctcgttttgtcgtctggccatacctggagacatacactgaggatgtttccagtgaaataatgaaagaaatgcaggccaagcctgaccttatcattggcaactacagcgatggcaacctagtcgccactctgctcgcacacaagttgggagtcactcattgtaccatcgctcatgccttggagaaaaccaaataccccaactcggacatctacttggacaagtcgacagcc

SEQ ID NO: 871 - DNA, 245 bp, Zea mays
gttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtcaacggcattgatgtgttcgaccccaggttcaacatcgtgtctcctggcgcggacctgtccacctacttcccgtaaaccgattcgcacaagaggctgacctccc

SEQ ID NO: 872 - DNA, 277 bp, Zea mays
aggagagtttgtaccccttgctgaattcctcaaggctcataactacaagggcacgacgatgttgttgaatgacagaatccaaagccttcgtggtctccaatcatccctgagaaaggcagaggagtatctactgagtgttcctcaagacactctctactcggagttcaaccataggttccaagagcttggcttggagaagggttggggtgacatgcgaacgtgtactcgacacactccattgcttctcgaccttctggaggccctgatccgccaattg

SEQ ID NO: 873 - DNA, 247 bp, Zea mays
ctcgagccgctcgagccgggcacgacgatgatgttgaatgacagaatccaaagccttcgtggtctccactcatccctgagaaaggcagaggagtatctactgagtgttcctcaagacactccctactcggagttcaaccataggttccaagagcttggtttggagaagggttggggtgacactgcgaacgtgtactcgacacactccacttgcttcttgaccttcttgaggcccctgatcctgccaa

SEQ ID NO: 874 - DNA, 231 bp, Zea mays
gggcgacaaggcgtcggccctgctcgtggacttcttcgacaagtgccaagaggagcgatgccactggagcaagatctcccagggcgggctccagcgtatcgaggagaagtacacctggaagctgtactcggagaggctgatgaccctcaccggcgtgtacgggttctggaagtacgtgtccaacctggagaggcgcgagacccggcggtacctggagatgctgtacgcgct

SEQ ID NO: 875 - DNA, 266 bp, Zea mays
cggacgcgtgggcggacgcgtgggcggacgcgtgggttggaactataccaatgatgttcaacgttgttatactgtctcctcatggctacttcgcacagtccaatgtgcttggataccctgacactggcggtcaggttgtgtacattctggatcaggtccgtgctttggagaatgagatgcttctgaggattaagcagcaaggccttgatatcactccgaagatcctcattgttaccaggctgttgcctgatgctgctgggactacg

SEQ ID NO: 876 - DNA, 169 bp, Zea mays
cgctcaagctaatgtcttgggttaccctgacaccggaggccaggttgtctacatcttggatcaagtgcgcgctatggagaacgaaatgctgctgaggatcaagcagtgtggtcctgacatcacgccgaagatccctaatgtccacaggttgctccctgatgcaactggc

SEQ ID NO: 877 - DNA, 306 bp, Zea mays
aaggacagggaggagcaggcggagttcaagaagatgtacagcctcatcgacgagtacaagttgaagggccatatccggtggatctcggcgcagatgaaccgcgtccgcaacggggagctgtaccgctacatttgcgatacgaagggcgcattcgtgcagcctgcgttctacgaagcgttcggcctgactgtgatcgagtccatgacgtgcggtctgccaacgatcgcgacctgccatggtggccctgctgagatcatcgtggacggggtatctggcctgcacattgacccttaccacagcgacaag

SEQ ID NO: 878 - DNA, 244 bp, Zea mays
ttcggcacgagacaagatctcacagggcggcctgcagagaatctatgagaagtacacctggaagctctactccgagaggctgatgaccctgaccggcgtgtacgggttctggaagtacgtgagcaacctggagaggcgcgagacccgccgctacatcgagatgttctacgccctgaagtaccgtagcctggcaagccaggttccgctgtccttcgattagtacggggaaagaagaagaagaaga

SEQ ID NO: 879 - DNA, 214 bp, Zea mays
acggaaaccgacaagagactcactgccttccatcctgaaatcgaggagctcatctacagcgacgtcgagaactccgagcacaagttcgtgctgaaggacaagaagaagccgatcatcttctcgatggcgcgtctcgaccgcgtgaagaacatgacaggcctggtcgagatgtacggcaagaacgcgcgcctgagggagctggcgaacctcgtga

SEQ ID NO: 880 - DNA, 213 bp, Zea mays
gagattgctggagagcttcaggccaatcctgacctgatcatcggaaactacagtgacggaaaccttgttgcgtgtttgctcgcccacaagatgggtgttactcactgtaccattgcccatgcgcttgagaaaactaagtaccctaactccgacctctactggaagaagtttgaggatcactaccacttctcgtgccagttcaccactgacttg

SEQ ID NO: 881 - DNA, 239 bp, Zea mays
ctcatgccttggagaaaaccaaataccccaactcggacatatacttggacaaattcgacagccagtaccacttctcttgccagttcacagctgaccttattgccatgaaccacaccgttttcatcatcaccagcacattccttgtttatctcgggaagcaaggacaccgtggggcagtacgagtcccacatcgcgttcactcttcctgggctctaccgtgtcgtccatggcatgatgtt

SEQ ID NO: 882 - DNA, 215 bp, Zea mays
acaagagactcactgccttccatcctgaaatcgaggagctcatctacagcgacgtcgagaactccgagcacaagttcgtgctgaaggacaagaagaagccgatcatcttctcgatggcgcgtctcgaccgcgtgaagaacatgacaggcctggtcgagatgtacggcaagaacgcgcgcctgagggagctggcgaacctcgtgatcgttgccggt

SEQ ID NO: 883 - DNA, 253 bp, Zea mays
gctgcttgaccttcttgaggcccctgatcctgccaacttggagaagttccttggaactataccaatgatgttcaatgttgtgatcctttctcctcatggctacttcgctcagtccaatgtgcttggataccctgacactggcggtcaggttgtgtacattctggatcaagtccgtgctttggagaatgagatgcttctgaggattaagcagcaaggccttgatatcactccgaagatcctcattgttaccagg

SEQ ID NO: 884 - DNA, 265 bp, Zea mays
cttcccgtacaccgagtcgcacaagaggctgacctcccttcacccggagattgaggagctcctgtacagccaaaccgagaacacggagcacaagttcgttctgaacgacaggaacaagccaatcattcttgtttgctacctccaaatcgggggcgcttgttctcgaccgtgtgaagaacttgactgggctggtggagctgtacggccggaacaagcggctgcaggagctggtgaacctcgtggtcgtctgcggcgaccatggcaa

SEQ ID NO: 885 - DNA, 213 bp, Zea mays
ctgaatttcaccacaggttccaggaacttggtctggagaagggttggggtgattgcgctaagcgtgcacaggagactatccacctcctcttgggactcctggaagccccagaatcgttcaacctggagaagttccctggaacgattcccatggtgttcaatggcggtaacctctcccctcatgggtacttcgctcaagctaatgtcctggggt

SEQ ID NO: 886 - DNA, 230 bp, Zea mays
ctcgtgatcgttgccggtgaccacggcaaggagtccaaggacatggaggagcaggcggagttcaagaagatgtacagcctcatcgacgcgtacaagttgaagggccatatccggtggatctcggcgcagatgaaccgcgtccgcaacggggagctgtaccgctacatttgcgatacgaagggcgcattcgtgcagcctgcgttctacgaagcgttcggcctgactgtgat

SEQ ID NO: 887 - DNA, 227 bp, Zea mays
  unsure (1)..(227): unsure at all n locations
gacaagtgccagccggacgangccactggagcaagatctcccagggcgggctccagcgtatcgaggagaagtacacctggaagctgtactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctg

SEQ ID NO: 888 - DNA, 231 bp, Zea mays
cccacgcgtccgcttggacaaattcgacagccagtaccacttctcttgccagttcacagctgaccttattgccatgaaccacaccgatttcatcatcaccagcacattccaagaaatcgcgggaagcaaggacaccgtggggcagtacgagtcccacatcgcgttcactcttcctgggctctaccgtgtcgtccatggcatcgatgttttcgatcccaagttcaacattgt

SEQ ID NO: 889 - DNA, 248 bp, Zea mays
ctcgatggcgcgtctcgagaagatgatcggcttcttcttgatggcgcgtctcgaccgcgtgaagaacatgacaggcctggtggagatgtacggcaagaacgcgcgcctgagggagctggcgaacctcgtgatcgtcgccggtgaccacggcaaggagtccaaggacagggaggagcaggcggagttcaagaagatgtacagcctcatcgacgagtacaagttgaagggccatatccggtggatctcgg

SEQ ID NO: 890 - DNA, 227 bp, Zea mays
gaatcgttcgcaagtggatctcgcgatttgaagtctggccgtacctggagacttacactgatgacgtggcgcatgagattgctggagagcttcaggccaatcctgacctgatcattggaaactacagtgacggaaaccttgttgcgtgtttgctcgcccacaagatgggtgttactcactgtaccattgcccatgcgcttgagaaaactaagtaccctaactccgac

SEQ ID NO: 891 - DNA, 295 bp, Zea mays
gttctagatcgcgagcagccgcccttttttttttttttttttttcaggaaaagggctccaaggccactacgattattattcaaggagcaacatcccatccaggaaacaaagggagcaccacacccgactgcacacacaccaccaccaccaccgttccctctcaaccgacgcaacgcaaactactaacagtccatcagactactaaaagcgacacccggatcaatgatggaacaagaccttgacaaggtaggtaaatttaactcttgaagcaaagagcagcaacgaacgcccgccg

SEQ ID NO: 892 - DNA, 225 bp, Zea mays
ttcggcacgagacaagatctcacagggcggcctgcagagaatctatgagaagtacacctggaagctctactccgagaggctgatgaccctgaccggcgtgtacgggttctggaagtacgtgagcaacctggagaggcgcgagacccgccgctacatcgagatgttctacgccctgaagtaccgtagcctggcaagccaggttccgctgtccttcgattagtacgg

SEQ ID NO: 893 - DNA, 245 bp, Zea mays
gggagacaatgttgaacttgggatcgaaaaccgacaagagactcactggcttcgatcctgaaatcgaggagctcatcaacagcgacgtcgagaactccgagcacaagttcgtgctgaaggacaagaagaagccgatcatcttctcgatggcgcgtctcgaccgcgtgaagaacatgacaggcctggtggagatgtacggcaagaacgcgcgcctgagggagctggcgaacctcgtgatcgtcgcc

SEQ ID NO: 894 - DNA, 221 bp, Zea mays
acggaaaccgacaagagactcactgccttccatcctgaaatcgaggagctcatcaacagcgacgtcgagaactccgagcacaagttcgtgctgaaggacaagaagaagccgatcatcttctcgatggcgcgtctcgaccgcggaagaacatgacaggcctggtggagatgtacggcaagaacgcgcgcctgagggagctggcgaacctcgtaatcgtcgcg

SEQ ID NO: 895 - DNA, 247 bp, Zea mays
aatttacctaccttgtcaaggtcttgttccatcattgatccgggtgtcgcttttttagtagtctgatggactgttagtagtttgcgttgcgtcggttgagagggaacgttggtggtggtggtgtgtgtgcagtcaggcgtggtgctccctttgtttcctggatgggatgttgctccttgaataataatcgtagtggccttggagcccttttcctgaaaaaaaacaaaaagagagttggagatgagga

SEQ ID NO: 896 - DNA, 254 bp, Zea mays
gaggattaagcagcaaggccttgatacactccgaagatcctcattgttaccaggctgttgcctgatgctgctgggactacgtgcggtcagcggctggagaaggtcattggtactgagcacacagacatcattcgcgttccgttcagaaatgagaatggcatcctccgcaagtggatctctcgttttgatgtctggccatacctggagacatacactgaggatgtttccagtgaaataatgaaagaactgcaggc

SEQ ID NO: 897 - DNA, 229 bp, Zea mays
cccacgcgtccgcccacgcgtccgcttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcag

SEQ ID NO: 898 - DNA, 221 bp, Zea mays
cggacgctggtgtagcgctaagcgtgcacaggagactatccacctcctcttggacctcctggaggccccaccatccgtccaccctggagaagttccttggaacgatccccatggtgttcaatgtcgttatcctctcccctcatggttacttcgctcaagctaatgtcttgggttaccctgacaccggaggccaggttgtctacatcttggatcaagtgcgc

SEQ ID NO: 899 - DNA, 224 bp, Zea mays
cgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgt

SEQ ID NO: 900 - DNA, 220 bp, Zea mays
acggaaaccgacaagagactcactgccttccatcctgaaatcgaggagctcatcaacagcgacgtcgagaactccgagcacaagttcgtgctgaaggacaagaagaagccgatcatcttctcgatggcgcgtctcgaccgcggaagaacatgacaggcctggtggagatgtacggcaagaacgcgcgcctgagggagctggcgaacctcgtgatcgtcgc

SEQ ID NO: 901 - DNA, 252 bp, Zea mays
agacgagtcccacattcctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgagaactccgagcaagtcgtgaaggacaagaagaagccgatcatcttctcgatggcgcgtctcgaccgcgtgag

SEQ ID NO: 902 - DNA, 253 bp, Zea mays
cccacgcgtccgcccacgcgtcagccacgcgtccgcccacgcgtccgcatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctgg

SEQ ID NO: 903 - DNA, 228 bp, Zea mays
aagatactcactgccttccatcctgaaatcgaggagctcgtctacagcgacgtcgagaactccgagcacaagttcgtgctgaaagacaagaagaagccgatcatcttctcgatggcgcgtctcgaccgcgtgaagaacatgacaggccttgtcgagatgtacggcaagaacgcgcgcctgagggagctggcgaacctcgtgatcgttgccggtgaccacggcaaggag

SEQ ID NO: 904 - DNA, 197 bp, Zea mays
cccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggc

SEQ ID NO: 905 - DNA, 310 bp, Zea mays
  unsure (1)..(310): unsure at all n locations
cgctcaagtaccgcaccatggcgagcaccgtgccgctggccgtggagggagagccctccagcaagtgatgcgcgacggcggccacagacctgatcgatcgatgagcganagggagcactcggagtgtcgagtcttttcccttgccatttctttctttttttcccttcccggaggcgaaaaaaaagagtctgcttttgctaggctgcgggcgttcgttgctgctctttgcttcaagagttaaatttacctaccttgtcaaggtcttgttccatcattgatccgggtgtcgcttttttagtagtctgatgga

SEQ ID NO: 906 - DNA, 237 bp, Zea mays
gaacagaaaacggaatcgttcgcaagtggatctcgcgatttgaagtctggccgtacctggagacttacactgatgacgtggcgcatgagattgctggagagcttcaggccaatcctgacctgatcatcggaaactacagtgacggaaaccttgttgcgtgtttgctcgcccacaagatgggtgttactcactgtaaccattgccatgcgcttgagaaaactaagtaccctaactccg

SEQ ID NO: 907 - DNA, 266 bp, Zea mays
cgacaaggcctgcagagaatctatgagaagtacacctggaagctctactccgagaggctgatgaccctgaccggcgtgtacgggttctggaagtacgtgagcaacctggagaggcgcgagacccgccgctacatcgagatgttctacgccctgaagtaccgtagcctggcaagccaggttccgctgtccttcgattagtacggggaaagaagaagaagaagaagcccaggccggagaaccatcgcctgcatttcgatctgtttcac

SEQ ID NO: 908 - DNA, 252 bp, Zea mays
caaagtccttggcaccgagcactgccatatccttcgcgtgccattcactacagtgaacggaatcgttcgctagtggatctcgcgatttgaagtctggccgtacctggagacttacactgacgacgtggcgcatgagattactggagagcgacaggccaatcctgacctgaccatcggaaactacagtgacggaaaccttgttgcgtgtttgctcgacgacaagatgggcgttactcactgtacaattgccca

SEQ ID NO: 909 - DNA, 252 bp, Zea mays
gcaccatggcgagcaccgtgccgctggccgtggagggagagccctccagcaagtgatgcgcgacggcggccacagacctgatcgatcgatgagcgagagggagcactcggagtgtcgtgtcttttcccttgccatttctttctttttttcccttcccggaagcgaaaaaaagagtctgcttttgtaagcggcgggcgttcgttgctgctctttgcttcaagagtttaaatttacctaccttgtcaaaggtct

SEQ ID NO: 910 - DNA, 240 bp, Zea mays
ctcgagcgaatcggctcacggctcgagtggctacttcgctcagtccaatgtgattggataccctgacactagcggtcaggatgtgtacattctggatcaggtccgtgctttggagaatgagatgcttctgaggattaagcagcaaggccttgatatcactccgaagatcctcattgttaccaggctgttgcctgatgctgctgggactacgtgcggtcagcggctggagaaggtcatggt

SEQ ID NO: 911 - DNA, 264 bp, Zea mays
cggacgcgtggcggacgcgtgggcggacgcgtgggcaagttcgtgctgaaggacaagaagaagccgatacatcttctcgatggcgcgtctcgaccgcgtgaagaacatgacaggcctggtggagatgtacggcaagaacgcgcgcctgagggagctggcgaacctcgtgatcgtcgccggtgaccacggcaaggagtccaaggacagggaggagcaggcggagttcaagaagatgtacagcctcatcgacgagtacaagttgaa

SEQ ID NO: 912 - DNA, 216 bp, Zea mays
  unsure (1)..(216): unsure at all n locations
gcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaacanggagcacaagttcgttctgaangacaggaacangcnatcatcttctcgatggcncgtng

SEQ ID NO: 913 - DNA, 215 bp, Zea mays
acagctgcaaaggtaagcactaggatgctgctcttatttcaggaaaagggctccaaggccactacgattattattcaaggagcaacatcccatccaggatacaaagggagcaccacgcctgactgcacacacaccagcaccaccaacgttccctctcaaccgacgcaacgcaaactactaacagtccatcagactactaaaaaagcgacacccgg

SEQ ID NO: 914 - DNA, 202 bp, Zea mays
agcgatggcaacctagtcgccactctgctcgcgcacaagttgggagtcactcagtgtaccatcgctcatgccttggagaaaaccaaataccccaactcggacatatacttggacaaattcgacagccagtaccacttctcttgccagttcacagctgacttattgccatgaaccacaccgatttcatcatcaccagcacatt

SEQ ID NO: 915 - DNA, 197 bp, Zea mays
ccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctagttccggtacacggagtcgcacaagaggctgacttcctttcac

SEQ ID NO: 916 - DNA, 234 bp, Zea mays
cccacgcgtccggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgc

SEQ ID NO: 917 - DNA, 252 bp, Zea mays
  unsure (1)..(252): unsure at all n locations
atncagcgctcgagccgctcgagcgctcacttctcgatggcgcgtctcgaccgcgtgaagcccatgacaggactggacgagatgtacggcaagaacgcgcgcctgagggagctggcgaacctcgtgatcgttgccggtgaccacggcaaggagtccaaggacagggaggagcaggcggagttcaagaagatgtacagcctcatcgacgagtacaagttgaagggccatatccggtggatctcggcgcagatg

SEQ ID NO: 918 - DNA, 249 bp, Zea mays
gcgcgcctgagaggagctggcgaacctcgtgatcgttgccggtgaccacggcaaggagtccaaggacatggaggagcaggcggagttcaagaagatgtacagcctcatcgacgagtacaagttgaagggccatatccggtggatactcggcgcagatgaaccgcgtccgcatacgggagctgtaccgctacatttgcgatacgaagggcgcattcgtgcagcctgcgttctacgaagcgttcggcctga

SEQ ID NO: 919 - DNA, 277 bp, Zea mays
aggacaccgtggggcagtacattccaacttcgggttcactcttcctggggctctaccgtgtcgtccatggcatcgatggtttcgatcccaagttcaacattgtctcccctggagaagacatgagtgtttactacccgtatagggaaacggacaagagattcactgccttccatcctgaaatcgaggtgctcatctacagcgacgtcgagaactccgagcacaagttcgtgctgaaggacaagaagaagccgatcatcttctcgtggcgcgtctcgac

SEQ ID NO: 920 - DNA, 190 bp, Zea mays
gatcgagtccatgacgtgcggtctgccaacgatcgcgacctgccatggtggccctgctgagatcatcgtggacggggtatctggcctgcacattgacccttaccacagcgacaaggccgcggatatcctggtcaacttctttgacaaatgcaaggcagatccgagctactgggacaagatctcagagggc

SEQ ID NO: 921 - DNA, 218 bp, Zea mays
cccacgcgtccgcccacgcgtccgcccacgcgtccgaaaccaaataccccaactcggacatctacttggacaagttcgacagccagtaccacttctcttgccagttcacagctgaccttattgccatgaaccacactgatttcatcatcaccagcacattccaagaaatcgcgggaagcaaggacaccgtggggcagtacgagtcccacatcgcgttc

SEQ ID NO: 922 - DNA, 180 bp, Zea mays
gtgtttactacccgtatacggaaaccgacaagagactcactgccttccatcctgaaatcgaggagctcatctacagcgacgtcgagaactccgagcacaagttcgtgctgaaggacaagaagaagccgatatcttctcgatggcgcgtctcgaccgcgtgaagaacatgacaggcctggt

SEQ ID NO: 923 - DNA, 239 bp, Zea mays
atcgagcgctcgagcgctcgaggctcgagttctcgatgacgcgtctcgaccgcatgaagaacatgacaggcctggatcagatgaccggcaagaacgcgcgcctgagggagctggcgaacctcgtgatcgttgccggtgaccacggcaaggagtccaaggacagggaggagcaggcggagttcaagaagatgtacagcctcatcgacgagtacaagttgaagggccatatccggtggatc

SEQ ID NO: 924 - DNA, 176 bp, Zea mays
cgggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgtacgggttctggaagtac

SEQ ID NO: 925 - DNA, 220 bp, Zea mays
ggcggcgggcgttcgttgctgctctttgcttcaagagttaaatttacctaccttgtcaaggtcttgttccatcattgatccgggtgtcgcttttttagtagtctgatggactgttagtagtttgcgttgcgtcggttgagagggaacgttggtggtggtggtgtgtgtgcagtcaggcgtggtgctccctttgtttcctggatgggatgttgctccttga

SEQ ID NO: 926 - DNA, 204 bp, Zea mays
atctccgcccagcgcaacggcgagctgtaccgctacatctgcgacaccaagggcgccttcgtgcagcctgctttctacgaggctttcgggctgacggtggttgaggccatgacctgcggcctgcccacgttcgccaccgcctacggcggtccggccgagatcatcgtgcacggcgtgtctggctaccacatatctccagggcga

SEQ ID NO: 927 - DNA, 203 bp, Zea mays
cggacgcgtggctgaatttcaccacaggttccaggaacttggtctggagaagggttggaggtgattgcgctaagcgtgcacaggagactatccacctcctcttggacctcctggaggccccagatccgtccaccctggagaagttccttggaaggttccccagggtgttcgatggcggaatcctctcccctcgtggttactgc

SEQ ID NO: 928 - DNA, 165 bp, Zea mays
ccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttca

SEQ ID NO: 929 - DNA, 175 bp, Zea mays
ctggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgctggcctgtacgggt

SEQ ID NO: 930 - DNA, 166 bp, Zea mays
gagctggcgaacctcgtgatcgttgccggtgaccacggcaaggagtccaaggacagggaggagcaggcggagttcaagaagatgtacagcctcatcgacgagtacaagttgaagggccatatacggtggatctcggcgcagatgaaccgcgtccgcaacggggagt

SEQ ID NO: 931 - DNA, 167 bp, Zea mays
atcactctgaagatcctcattgttaccaggctgttgcctgatgctgctgggactacgtgcggtcagcggctggagaaggtcattggtactgagcacacagacatcattcgcgttccgttcagaaatgagaatggcatcctccgcaagtggatctctcgttttgatgt

SEQ ID NO: 932 - DNA, 161 bp, Zea mays
agctgaccttattgccatgaaccacactgatttcatcatcaccagcacattccaagaaatcgcgggaagcaaggacaccgtggggcagtacgagtcccacatcgcgttcactcttcctgggctctaccgtgtcgtccatggcatcgatgttttcgatccca

SEQ ID NO: 933 - DNA, 177 bp, Zea mays
ctcgacggcgcgtctcgaccgcgtgaagaacatgacaggcctggtcgagatgtacggcaagaacgcgcgcctgacggagctggcgaacctcgtgatcgttgccggtgaccacggcaaggagtccaaggacatggaggagcaggcggagttcaagaagatgtacagcctcatcgacga

SEQ ID NO: 934 - DNA, 280 bp, Zea mays
gtagcctggcaagccaggttccgctgtccttcgattagtacggggaaagaagaagaagaagaagcccaggccggagaaccatcgcctgcatttcgatctgtttcaccgcaattcgcattgttagtcgtgtattggagttatgtgtacttggtttccaagaactttggttccttctcgttttttttccttgtttgatcgctttttggcagcgctggcctggttcctagtatggtgggaattggctgcaccttttgcttcgaataaaaatgcctgctcgttc

SEQ ID NO: 935 - DNA, 286 bp, Zea mays
aggagagtttgtaccccttgctgaacttcctcaaggctcataactacaagggcacgacgatgatgttgaatgacagaatccaaagccttcgtggtctccaatcatccctgagaaaggcagaggagtatctactgagtgttcctcaagacactccctactcggagttcaaccataggttccaagagcttggtttggagaagggttggggtgacactgccaacgtgtactcgacacactccacttgcttcttagacttcttgaggcccctgatcctgccaacttggga

SEQ ID NO: 936 - DNA, 164 bp, Zea mays
cccacgcgtccgcccacgcgtccgggttctggaagtacgtgtccaacctggagaggcgcgagacccggcggtacctggagatgctgtacgcgctcaagtaccgcaccatggcgagcaccgtgccgctggccgtggagggagattcctccagcaagtgatgcgtg

SEQ ID NO: 937 - DNA, 208 bp, Zea mays
cagacgcgtggcccgtacaccgagtcgcacaagaggctgacctcccttcacccggagattgacaggtccgacgccaggagacacgatgttgaacttggggtcgaacacatcaatgccgtggacaacgcggtacaggccaggcattgtgaacgccatgtgtgactcgtactggccgacggtgtccttgtttccggcgatctcttggaag

SEQ ID NO: 938 - DNA, 304 bp, Zea mays
cgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactggtctggtggagctgtacggccggaacaagcggctgcaggagctggtgaactcgtggtcgtctgcggcgacatggaacctccaagacaggagagcagcgattcagaagtgttgactcacgacagtaaactgaagggactccgtggactcg

SEQ ID NO: 939 - DNA, 184 bp, Zea mays
cgccgctacatcgagatgttctacgccctgaagtaccgtagcctggcaagccaggttccgctgtccttcgattagtacggggaaagaagaagaagaagaagcccaggccggagaaccatcgcctgcatttcgatctgtttcaccgcaattcgcattgttagtcgtgtattggagttatgtgtac

SEQ ID NO: 940 - DNA, 176 bp, Zea mays
ctaccgtgtcgtccatggcatcgatgttttcgatcccaagttcaacattgtctcccctggagcagacatgagtgtttactacacgtatacggagaccgacaagagactcactgccttccatcctgagatcgaggagctcatctacagcgacgtcgagaactccgagcacaagttcg

SEQ ID NO: 941 - DNA, 188 bp, Zea mays
gcaaggtagaggagtatctactgagtgtgcctcaagacactctgtagttggagttcaaccataggttccaagagcttggcttggggatagggttggggtgacactgtgaacgtgtactcgacacactccacttgcttctcgactttacggaggccccttatcctgccaacttggagaagttcctggga

SEQ ID NO: 942 - DNA, 142 bp, Zea mays
ctcattgttaccaggctgttgcctgatgctgctgggactacgtgcggtcagcggctggagaaggtcattggtactgagcacacagacatcattcgcgttccgttcagaaatgagaatggcatcctccgcaagtggatctctc

SEQ ID NO: 943 - DNA, 235 bp, Zea mays
agactggcaagccaggttccgctgtccttcgttagtacggggaaagaagaagaagaagaagcccaggccggagaaccatcgcctgcatttcgatctgtttcaccgcaattcgcattgttagtactgtattggagttatgtgtacttggtttccaagaactttggttccttctcgttttttttccttgtttgatcgattttgggcagcgctggcctggttcctagtatggtgggaa

SEQ ID NO: 944 - DNA, 136 bp, Zea mays
agccttcgtgcagcctgctttctacgaggctttcgggctgacggtggttgaagccatgacctgcagcctgcccacgtttgccacagcctacggcggtccggccgagatcatcgtgcacggcgtgtctgggtaccac

SEQ ID NO: 945 - DNA, 135 bp, Zea mays
tgcaatgaaccatgccgacttcatcatcaccagtaccttccaagagatcgccggaaacaaggacaccgtcggccagtacgagtcacacatggcgttcacaatgcctggcctgtaccgcgttgtccacggcattga

SEQ ID NO: 946 - DNA, 244 bp, Zea mays
gacttcttcgacaagtgccaggcggagcgatgccactggagcaagatctcccaaggcgggctccagcgtatcgaggagaagtacacctcgaaagtgtactcggagaggctgattacgctcaccggcgtgtatcggttctggaagtacgtgtccaacctggagaggcgcgatacccggcggtacctggagatgctgtacgcgctcaagtaccgcaccatggcgaccaccgtaccgctgccgtgga

SEQ ID NO: 947 - DNA, 158 bp, Zea mays
cccacgcgtccgcggagaggctgatgaccctcaccggcgtgtacgggttctggaagtacgtgtccaacctggagaggcgcgagactcggcggtacctggagatgctgtacgcgctcaagtaccgcaccatggcgagcaccgtgccgctggccgtggag

SEQ ID NO: 948 - DNA, 181 bp, Zea mays
cgagcaccgtgccgctggccgtggagggagagccctccagcaagtgatgcgtgacggcggccacagacctgatcgatcgatgagcgagagggagcactcggagtgtcgtgtcttttcccttgccatttctttctttcttctttttccttcccggaggcgaaaaaaaaagagtctgcttttg

SEQ ID NO: 949 - DNA, 145 bp, Zea mays
cactcagtgtaccatcgctcatgccttggagagaaccaaataccccaactcggacatatacttggacaaattcgacagccagtaccacttctcttgccagttcacagctgacctgattgccatgaaccacaccgatttcatcatg

SEQ ID NO: 950 - DNA, 151 bp, Zea mays
catcctgaaatcgaggagctcatctacagcgacgtcgagaattccgagcacaagttcgtgctgaaggacaagacgaagccgatcatcttctcgatggcgcgtctcgaccgcgtgaagaacatgacaggcctggtcgagatgtacggcaaaa

SEQ ID NO: 951 - DNA, 180 bp, Zea mays
cacacgcgtccgcccacgcgtccgcccacgcgtccgatcatcaccagtaccttccaagagatcgccggaaacaaggacaccgtcggccagtacgagtcacacatggcgttcacaatgcctgtcctgtaccgcgttgtccacggcattgatgtgttcgacccgagtttgaacatcgtgtct

SEQ ID NO: 952 - DNA, 116 bp, Zea mays
agaacacggagcacaagttcgttctgaacgacaggaacaagccaatcatcttctccatggctcgtctcgaccgtgtgaagaacttgactgggctggtggagctgtacggccggaaa

SEQ ID NO: 953 - DNA, 118 bp, Zea mays
cgttgttatcctgtctcctcatggctacttcgcccagtccaatgtgcttggataccctgacactggcggtcaggttgtgtacattctggatcaggtccgtgctttggagaatgagatg

SEQ ID NO: 954 - DNA, 113 bp, Zea mays
ggccttgatatcactccgaagatcctcattgttaccaggctgttgcctgatgctgctgggactacgtgcggtcagcggctggagaaggtcattggtactgagcacacagacat

SEQ ID NO: 955 - DNA, 136 bp, Zea mays
tcgagcgtgtccaacctggagaggcgcgagacgcggcggtacctggagatgctgtacgcgctcaagtaccgcaccatggcgagcaccgtgccgctagtcgtggagggagagccctaccagcaagtgatgcgtgcgg

SEQ ID NO: 956 - DNA, 124 bp, Zea mays
cttctcgtgccagttcaccactgacttgattgcaatgaaccatgccgacttcatcatcaccagtaccttccaagagatggccggaaacaaggacaccgtcggccagtacgagtcacacatggcg

SEQ ID NO: 957 - DNA, 106 bp, Zea mays
agaagaagccgatcatcttctcgatggcgcgtctcgaccgcgtgaagaacatgacaggcctggtcgagatgtacggcaagaacgcgcgcctgagggagctggcgaa

SEQ ID NO: 958 - DNA, 115 bp, Zea mays
cttgggttacctgacaccggaggccaggttgtctacatcttggatcaagtgcgcgctatggagaacgaaatgctgctgaggatcaagcagtgtggtcctgacatcacgccgaaga

SEQ ID NO: 959 - DNA, 138 bp, Zea mays
cggacgcgtgggcagacagagagagagagagatgagggtggtggtgtgtgtgcagtcgggtgtggtgctccctttgtttcctggatgggatgttgctccttgaataataatcgtagtggccttggagcccttttcctg

SEQ ID NO: 960 - DNA, 122 bp, Zea mays
ctccagcgtatcgaggagaagtacacctggaagctctactcggagaggctgatgaccctcaccggcgtgtacgggttctggaagtacgtgtccaacctgtagaggcgcgatacccggcggta

SEQ ID NO: 961 - DNA, 130 bp, Zea mays
cgagacgcgatgggcaaagctcttccatcacaaggagagcatgtaccccttgctcaacttccttcgcgcccacaactacaaggggatgaccatgatgttgaacgacaacatccgcagtctcagtgctctg

SEQ ID NO: 962 - DNA, 120 bp, Zea mays
ctccgagcacaagttcgtgctgaaggacaagaagaagccgatcatcttctcgatggcgcgtctcgaccggtgaagaacatgacaggcctggtggagatgtacggcaagaacgcgcgcctg

SEQ ID NO: 963 - DNA, 101 bp, Zea mays
ataccaatgatgttcaatgttgttatcctttctcctcatggctacttcgctcagtccaatgtgcttggataccctgacactggcggtcaggttgtgtacat

SEQ ID NO: 964 - DNA, 101 bp, Zea mays
gttctggaagtacgtgagcaacctggagaggcgcgagacccgccgctacatcgagatgttctacgccctgaagtaccgtagcctggcaagccaggttccgc

SEQ ID NO: 965 - DNA, 93 bp, Zea mays
gcaggcggagttcaagaagatgtacagcctcatcgacgagtacaagttgaagggccatatccggtggatctcggcgcagatgaaccgcgtccg

SEQ ID NO: 966 - DNA, 99 bp, Zea mays
cggcaactacagcgatggcaacctagtcgccactctgctcgcgcacaagttgggagtcactcagtgtaccatcgctcatgccttggagaaaaccaaata

SEQ ID NO: 967 - DNA, 84 bp, Zea mays
tgctccttgaataataatcgtagtggccttggagcccttttcctgaaataagagcagcatcctagtgcttacctttacagctgt

SEQ ID NO: 968 - DNA, 85 bp, Zea mays
attcgacagccagtaccacttctcttgccagtgcacagctgacctgattgccatgaaccacaccgatttcatcatcaccagcaca

SEQ ID NO: 969 - DNA, 97 bp, Zea mays
gcgacgtcgagaactccgagcacaagttcgtgctgaaggacaagaagaagccgatcatcttctcgatggcgcgtctcgaccgcgtgaagaacatgac

SEQ ID NO: 970 - DNA, 102 bp, Zea mays
cagtaccgtggagccagagtcgcacaaatggctgacctcccttacaccggagattgatgagctcctgtacagctaaaccgagaacacggagcacaagttcgt

SEQ ID NO: 971 - DNA, 89 bp, Zea mays
cggctcgagcttggacaaattcgacagccagtaccacttctcttgccagttcacagctgaccttattgccatgaaccacaccgatttca

SEQ ID NO: 972 - DNA, 297 bp, Zea mays
ctgcttgctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcaggaagcaattgtgctccccccatgggttgcacttgct

SEQ ID NO: 973 - DNA, 318 bp, Zea mays
tggactgcttgctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcaggaagcaattgtgctccccccatgggttgcacttgctatcaggccaaggcctgg

SEQ ID NO: 974 - DNA, 288 bp, Zea mays
atcagctgcttgcggagtttgatgccctgtttgctagtgacaaggataagtatgcaccctttgaagacattcttcgtgctgctcaggaagcaattgtgctccccccatgggttgcacttgctatcaggccaaggcctggtgtctgggattacattcgggtgaatgtaagtgagctggctgtggaggagctgagtgtttctgagtacttggcattcaaggaacagctggtggatggacaatccaacagcaactttgtgcttgagcttgattttgagcccttcaatgcct

SEQ ID NO: 975 - DNA, 303 bp, Zea mays
ggactgcttgctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcaggaagcaattgtgctccccccatgggttgcacttgctatc

SEQ ID NO: 976 - DNA, 274 bp, Zea mays
aatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcaggaagcaattgtgctccccccatgggttgcacttgctatcaggccaaggcctggtgtctgggattacattcgggtgaatgtaagtgagctggctgtggaggagctgagtgtttctgagtacttggcat

SEQ ID NO: 977 - DNA, 283 bp, Zea mays
gcttgctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcaggaagcaattgtgctccccgcatgg

SEQ ID NO: 978 - DNA, 263 bp, Zea mays
gctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcaggaagcaat

SEQ ID NO: 979 - DNA, 262 bp, Zea mays
attggactgcttgctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctg

SEQ ID NO: 980 - DNA, 250 bp, Zea mays
gctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctg

SEQ ID NO: 981 - DNA, 274 bp, Zea mays
ttggactgcttgctccctgttgaccattgggtattctgaaccatcgagccatcgctgccaagctgactcgcctccacagtcttcgcgaacgccttggtgccaccttctcctcccatcccaatgaactgatagcactcttttccaggtatgttcaccagggcaagggcatgcttcagcgccatcagctgcttgcggagtctgatgccctgtttgatagtgacaaggagaagtatgcaccctttgaagacattcttcgtgctgctcaggaagcaat

SEQ ID NO: 982 - DNA, 233 bp, Zea mays
ctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagaca

SEQ ID NO: 983 - DNA, 217 bp, Zea mays
ggactgcttgctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtg

SEQ ID NO: 984 - DNA, 258 bp, Zea mays
actgcttgctccctgttgaccattgggtattctgaaccatcgagccaacgctgccaagctgactcgcctccacagtcttcgcgaacaccttggtgccaccttctcctcccatcccaatgaactgatagcactcttttccagttatgttcaccagggcaagggaatgcttcagcgccatcagctgcttgcgtgagtttgatgccctgtttgatagtgacaaggagaagtatgcaccctttgaagacatcctcgtgctgc

SEQ ID NO: 985 - DNA, 243 bp, Zea mays
cccacgcgtccggacccacgcgtccgagacattcttcgtgctgctcaggaagcgattgtgctccccccatgggttgcacttgctatcaggccaaggcctggtgtctgggattacattcgggtgaatgtaagtgagctggctgtgggagagctgagtgtttctgagtacttggcattcaaggaacagctggtggatggacaatccaacagcaactttgtgcttgagcttgattttgagcccttc

SEQ ID NO: 986 - DNA, 247 bp, Zea mays
cattggactgcttgtccctgttgaccattgggtattctgtaccatcgagccatagctgccacgctgactcgcctccacagtcttcgcgaacgccttggtgccaccttctcctcccatcccaatgaactgatagcactcttttccaggtatgttcaccagggcaagggactgcttcagcgccatcagctgcttgcggagtttgatgccctgtttgcatatgacaggagcagtatgcaccctttgaaga

SEQ ID NO: 987 - DNA, 211 bp, Zea mays
gctccctgttgaccattgggtatctgaaccatcgagccatagctgccaagctgactcgactccacagtcatcgcgaacgccttggtgccaccttctcctcccatcccaatgaactgatagcactcttttccaggtatgttcaccagggcatgggaatgcttcagcgccatcagctgcttgcggagtttgatgccctgtttcatagtgacac

SEQ ID NO: 988 - DNA, 150 bp, Zea mays
attggactgcttgctccctgttgaccattgggtattctgaaccatcgagccatggctgccaagctgactcgcctccacagtcttcgcgaccgtcttggtgccaccttctcctcccatcccaatgaactgatagcactcttttccaggtat

SEQ ID NO: 989 - DNA, 128 bp, Zea mays
ttggactgcttgctccctgttgaccattgggtattctgaaccatcgagccatggctgccaagctgactcgcctccacagtcttcgcgaacgccttggtgccaccttctcctcccatcccaatgaactg

SEQ ID NO: 990 - DNA, 125 bp, Zea mays
tccattggactgcttgctccctgttgaccattgggtattctgaaccatcgagccatggctgccaagctgactcgcctccacagtcttcgcgaacgccttggtgccaccttctcctcccatcccaa

SEQ ID NO: 991 - DNA, 116 bp, Zea mays
attggactgcttgctccctgttgaccattgggtattctgaaccatcgagccatggctgccaagctgactcgcctccacagtcttcgcgaacggcttggtgccaccttctcctccca

SEQ ID NO: 992 - DNA, 298 bp, Zea mays
cctccgttcaccccgtccatttgatttgcgttcactgcgttgcgtttccttggaggggattgttctctcctctcctttggattggaggtccctccttcttctcctctctctctcagaggaaggcctgaggatccaggaagaggacagcaatgggggaaggtgcaggtgaccgtgtcctgagccgcctccacagcgtcagggagcgcattggcgactcactctctgccacacccaatgagcttgtcgccgtctttcacaggctgaaaaacctttggaaaggtatgctgcagcccaccag

SEQ ID NO: 993 - DNA, 291 bp, Zea mays
cccgtccatttgatttgcgttcactgcgttgcgtttccttggaggggattgttctctcctctcctttggattggaggtccctccttcttctcctctctctctcagaggaaggcctgaggatccaggaagaggacagcaatgggggaaggtgcaggtgaccgtgtcctgagccgcctccacagcgtcagggagcgcattggcgactcactctctgcccaccccaatgagcttgtcgccgtcttcaccaggctgaaaaaccttggaaagggtatgctgcagccccaccagatc

SEQ ID NO: 994 - DNA, 263 bp, Zea mays
agttcatcgattcagttcttgcctgaggatccaggaagaggacagcaatgggggaaggtgcaggtgaccgtgtcctgagccgcctccacagcgtcagggagcgcattggcgactcactctctgcccaccccaatgagcttgtcgccgtcttcaccaggctgaaaaaccttggaaagggtatgctgcagccccaccagatcattgccgagtacaacaatgcgatccctgaggctgagcgcgagaagctcaaggatggtgctttt

SEQ ID NO: 995 - DNA, 267 bp, Zea mays
ctccgttcaccccgtccatttgatttgcgttcactgcgttgcggggccttggaagggattgttctctcctctcctttggattggaggtccctccttcttctcctctctctctcagaggaaggcctgaggatccaggaagaggacagcaatgggggaaggtgcaggtgaccgtgtcctgagccgcctccacagcgtcagggagcgcattggcgactcactctctgcccaccccaatgagcttgtcgccgtcttcaccaggctgaaaaa

SEQ ID NO: 996 - DNA, 266 bp, Zea mays
cacacgcgtccgcggacgcgtggccgttcaccccgtccatttgatttgcgttcactgcgttgcgtttccttggacgggcttgttctctcctctcctttggattggaggtccctccttcttctcctctctctctcagaggaaggcctgaggatccaggaagaggacagcaatgggggaaggtgcaggtgaccgtgtcctgagccgcctccacagcgtcagggagcgcattggcgactcactctctgcccaccccaatgagcttgtcg

SEQ ID NO: 997 - DNA, 303 bp, Zea mays
ttgatttgcgttcactgcgttgcgtttccttggaggggattgttctctcctctcctttggattggaggtccctccttcttctcctctctctctcagaggaaggcctgaggatccaggaagaggacagcaatgggggaaggtgcaggtgaccgtgtcctgagccgcctccacagcgtcagggagcgcattggcgactcactctctgcccaccccaatgagcttgtcgccgtcttcaccaggctgaaaaaccttggaaatggtatgctgcagccccaccagatcattgccgagtacaacaatgcg

SEQ ID NO: 998 - DNA, 229 bp, Zea mays
ccccgtccatttgatttgcgttcactgcgttgcgtttccttggaggggattgttctctcctctcctttggattggaggtccctccttcttctcctctctctctcagaggaaggcctgaggatccaggaagaggacagcaatgggggaaggtgcaggtgaccgtgtcctgagccgcctccacagcgtcagggagcgcatgggcgactcactctctgcccaccccaatgag

SEQ ID NO: 999 - DNA, 298 bp, Zea mays
ggggattgttctctcctctcctttggattggaggtccctccttcttctcctctctctctcagaggaaggcctgatgatccaggaagacgacagcaatgggggaaggtgcaggtgaccgtgtcctgagccgcctccacagcgtcagggagcgcattggcgactcactctctgcccaccccaatgagcttgtcgccgtcttcaccaggctgaaaaaccttggaaagggtatgctgcagccccaccagatcattgccgagtacaacaatgcgatccctgaggctgagcgcgagaagctcaa

SEQ ID NO: 1000 - DNA, 257 bp, Zea mays
attccacctccgttcaccccgtccatttgatttgcgttcactgcgttgcgtttccttggaggggattgttctctcctctcctttggattggaggtccctccttcttctcctctctctctcagaggaaggcctgaggattcaggaagaggacagcaatgggggaaggtgcaggtgaccgtgtcctgagccgcctccacagcgtcagggagcgcattggcgattcattttttgccaaccccattaaccttgtcgcggtt

SEQ ID NO: 1001 - DNA, 292 bp, Zea mays
ccccgtccatttgatttgcgttcactgccctgcgtttccttggaggggactgttctctcctctcctctggcctccgaggtcgctccttcttctcctctctctctcagaggaaggcctgacgatgcaggaagaggacagcaatgggggaacgtgcaggtgaccgtgtcctgagccgcctccacagcgtcatggagcgcattggcgactcactctctgcgcaccccaatgagcttgtcgccgtcttcaccaggcggaaaaagcttggaaagggtatgctgcagccgcaccagat

SEQ ID NO: 1002 - DNA, 220 bp, Zea mays
cccacgcgtccggcgttgcgtttccttggaggggattgttctctcctctcctttggattggaggtccctccttcttctcctctctctctcagaggaaggcctgaggatccaggaagaggacagcaatgggggaaggtgcaggtgaccgtgtcctgagccgcctccacagcgtcagggagcgcattggcgactcactctctgcccaccccaatgagcttgt

SEQ ID NO: 1003 - DNA, 125 bp, Zea mays
cccacgcgtccgcgcctccacagcgtcagggagcgcattggcgactcactctctgcccaccccaatgagcttgtcgccgtcttcaccaggctgaaaaaccttggaaagggtatgctgcagcccca

SEQ ID NO: 1004 - DNA, 127 bp, Zea mays
cccacgcgtccgatttgatttgcgttcactgcgttgcgtttccttggaggggattgttctctcctctcctttggattggaggtccctccttcttctccgctctctctcagaggaatgcctagggatc

SEQ ID NO: 1005 - DNA, 188 bp, Zea mays
  unsure (1)..(188): unsure at all n locations
actccgttcaccccgtccatttgatttgcgttcaccgcgntgcggttccttggaggggattgttctcaactctcctttggattggaggtccctccttcttctcctctctctctcagaggaaggcctgaggatccaggaagaggacagcaattggggaaggtgcaggtgaccgtgtcctgagccgcctc

SEQ ID NO: 1006 - DNA, 123 bp, Zea mays
atttgcgttcacagcgttgcgtttccttggaggggattgttctcacctctcctttggattggaggaccctccttcttctcctctctctctcagaggaaggcctgaggatccaggaagaggaca

SEQ ID NO: 1007 - DNA, 104 bp, Zea mays
tgcaggtgaccgtgtcctgagccgcctccacagcgtcagggagcgcattggcgactcactctctgcccaccccaatgagcttgtcgcgtcttcaccaggctgaa

SEQ ID NO: 1008 - DNA, 106 bp, Zea mays
tgcaggtgaccgtgtcctgagccgcctccacagcgtcagggagcgcattggcgactcattctctgcacaccccaatgagcttgtcgcgtcttcaccaggctgaaaa

SEQ ID NO: 1009 - DNA, 126 bp, Zea mays
gtttcagttcatcgattcagttcttgcctgaggatccaggaagaggacagcaatgggagaacgtgcaggtgaccgtgtcctgagccgcctccacagcgtcaaggagcgcattggcgactcactctc

SEQ ID NO: 1010 - DNA, 242 bp, Zea mays
  unsure (1)..(242): unsure at all n locations
tcgacggcacgcgtccangcgtgacgcggngttgntcggcacnaancttcacntcanagcaactacctnaactngtgngggctgaccgttgacgactactaaggagtccaaggacaggnaggancangcngagttcangaagatgtacangctnatnnactagtacaagttgnanggccatatccggtggatctnggctcacatgaacnantttcncaatngaaacctgtnccgttacataa

SEQ ID NO: 1011 - DNA, 229 bp, Zea mays
tctttgacaaatgcaaggcagatccgtgctactggtacaagatctcacagggcggcgtgcacagaatctatgagacgtacacctggaagctctacttcgagaggctgatgaccctgaccggcgtgtacggcttctggaagtacgtgagcatactgtagaggcacgagaccctccgctacatcgagatgtactacgccctgaagcaccggatcctggcaagccaggttcc

SEQ ID NO: 1012 - DNA, 455 bp, Zea mays
atgttattgtaaatatattattggaagggaagggtttgatcatgcatagaagttatgctaacgctctcgattcccggtcgaccccgcgtccggttctgagtacttggcattcaaggaacagctggtggatggacaatccaacaacaactgtgtgcttgagcttgattaggagcccttcaatgcctactttcctcgtccttacatgtcgaagtccatcggacatggaatgcaattccttaaccgacacctgtcgtccaagttgttccaggacaaggagagttcgtaccccttgctgaacttcctcaaggctcataactacaaaggccacgacgatgatgttggatgacagaattccaagccttcgtggtctccaatcatccctgaaaaaggcagaagagtatctactgagtgttccttaagacactccctactcggagttcaaccataggttccaa

SEQ ID NO: 1013 - DNA, 178 bp, Zea mays
taaacaatgacaccgtcggccattacgagtcacacatggcgttcacaatgcctggcctgtaccgagtcgtccgcggaattgatgtgctctaccccaagttcaacatcctgtcttctggcgcggacctttccatctacttcccgtacactgagtcgcacacaaagctgaactgacttaa

SEQ ID NO: 1014 - DNA, 386 bp, Zea mays
gataagaatcatctttcttgaacacagaaggatgcactgcgcctgaccttactactcgactcagtcgaccatgccgacttgatcatcaccagtaccttccaagagatcgccggaaacaagtacaccgtcaggcggtggtatttacacatggggttgacgatgcctggcctgtaccgacttgcccactgcattgatgtcttccaccacaagctcaacatcgtgtctcctctcgcgcacctatccatctacttaccgtacacctactcgcacaatacactgacctgccttcacccggagattgaggagctcctgtacacacaatccgctaacactgagcacaacttcatacttaacgactggatcaaccccatcatattctacatggc

SEQ ID NO: 1015 - DNA, 428 bp, Zea mays
cgcggcagacggtagccgacttcttcgaccggtgcaagcaagacccagatcactgggggagaatatctggagcagggctgcagcgcatatacgagaagtacacatggaagatatactcagagaggttgatgacactggccggggtctacggtttctggaagtacgtgtcgaagctcgagaggcgggagacgaggcgctaccttgagatgttctacatactgaagttccgcgagctggcgaagaccgtgccgcttgcaattgaccaaccgcagtagcttgcgcaactgcgactgcgtagcacttggtacaagactgaaacctgaaggaccttcagtaatttaggcgcggcagacggtagccaataaaatgtgccggagctgaactggtttttattatgtacataatggcagtataacaaaattactgaa

SEQ ID NO: 1016 - DNA, 485 bp, Zea mays
  unsure (1)..(485): unsure at all n locations
gagttgctaatncccgttcncgtcattcgtcactcttcgtattaccgctggacgccactcatcctggagatgtttcgacctcatcgagcagtataacctgaacgggcacatccgctggatctcgttccattttaaccgcgtccgcgactgcgagctttaccgctacatctgcgacaccaatggcgccttcgtgcagcctgctttctacgatgctttcgggcttactgtggttgaggccatgacctgcggcctgcccacgtttgccacagcctacggctgtcctgccgagatcatcgtgcacggcgtgtctggctaccacattgacccttaccagggcgacaaggcttttgcccttgctcgtggacttttttgacaagtgccatgcttactcctagccactttgagcaagatcttccatggctggcttcaacttatctaggagaaattcccctggaaactttactcttataagctttttaccctta

SEQ ID NO: 1017 - DNA, 417 bp, Zea mays
cccacgcgtccgcggacgcgtgggttttgttttgccgaggccattggtgccatgcggccagcccttttcttctccatggttcccatcgatgtgtttttgttcggttctctcgtcagatctgtataaataggcgcctaccttctccgccattcctcggtcctgtgaagcgtttcagttcatcgattgagttcttggatgcctctagttgtattgtgtgtttcttctttctggtctatgtactaggactatagtaccaggatctgagtcgtttttttttgggtcttgctcctgtctgccgtttctttccccccttccagagttaggttctgttggtttcttgcctgcaatatagtttcgtggcgcaccgtcaagggtgtgtctagactttaaagactggttgttggcagttgggtttat

SEQ ID NO: 1018 - DNA, 411 bp, Zea mays
  unsure (1)..(411): unsure at all n locations
acactaattcgcagtgggcatctggatgaccggtcaaagcccaccctcttctccatggcaagactcgacagggtgaagaacataacggggctggtcgaagcttttgctaagtgcgctaagctgagggagctggtaaaccttgtcgtcgttgccgggtacaatgatgtcaacaagtccaaggacagggaagagatcgcggagatagagaagatgcatgaactcatcaagacncacaacttgttcgggcagtccgctggatcctgccagacaacaggcccgtaacgcgagctctatcgctacatcgctgataccaatggtgctttcgtacacccgggcctctatgaagcgttcggtctcaccgtcgttgaggccatgnactgtgggcttcctactttcgcgacgctccatgga

SEQ ID NO: 1019 - DNA, 478 bp, Zea mays
tgcagatgaaccatgccgacttcatcatcaccagtaccttccaagagatcgccggaaacaaggacaccgtcggccggtgcgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggaacaggccgagttcaagaagat

SEQ ID NO: 1020 - DNA, 469 bp, Zea mays
caaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgtacgggttctggaagtacgtg

SEQ ID NO: 1021 - DNA, 442 bp, Zea mays
tggcaacctagtcgccactctgctcgcgcacaagttgggagtcactcagtgtaccatggctcatgccttggagaaaaccaaataccccaactcggacatatacttggacaaattcgacagccagtaccacttctcttgccagttcacagctgaccttattgccatgaaccacaccgatttcatcatcaccagcacattccaagaaatcgcgggaagcaaggacaccgtggggcagtacgagtcccacatcgcgttcactcttcctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgagaactccgagcacaag

SEQ ID NO: 1022 - DNA, 441 bp, Zea mays
actcagtgtaccatcgctcatgccttgttagaaaaccaaataccccaactcggacggatacttggacaaattcgacagccagtaccacttctcttgccagttcacagctgaccttattgccatgaaccacaccgatttcatcatcaccagcacattccaagaaatcgcgggaagcaaggacaccgtggggcagtacgagtcccacatcgcgttcactcttcctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgagaactccgagcacaagttcgtgctgaaggacaagaagaagccgatcatcttctcgat

SEQ ID NO: 1023 - DNA, 453 bp, Zea mays
cccacgcgtccgggacaccgtcggccattacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaa

SEQ ID NO: 1024 - DNA, 444 bp, Zea mays
ctgaaggacaagaagaagccgatcatcttctcgatggcgcgtctcgaccgcgtgaagaacatgacaggcctggtcgagatgtacggcaagaacgcgcgcctgagggagctggcgaacctcgtgatcgttgccggtgaccacggcaaggagtccaaggacagggaggagcaggcggagttcaagaagatgtacagcctcatcgacgagtacaagttgaagggccatatccggtggatctcggcgcagatgaaccgcgtccgcaacggggagctgtaccgctacatttgcgatacgaagggcgcattcgtgcagcctgcgttctacgaagcgttcggcctgactgtgatcgagtccatgacgtgcggtctgccaacgatcgcgacctgccatggtggccctgctgagatcatcgtggacggggtatctggcctgcacattgaccct

SEQ ID NO: 1025 - DNA, 441 bp, Zea mays
caccgtggggcagtacgagtcccacatcgcgttcactcttcctgggctgtaccgtgtgatccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgagaactccgagcacaagttcgtgctgaaggacaagaagaagccgatcatcttctcgatggcgcgtctcgaccgcgtgaagaacatgacaggcctggtcgagatgtacggcaagaacgcgcgcctgagggagctggcgaacctcgtgatcgttgccggtgaccacggcaaggagtccaaggacagggaggagcaagcggagttcaagaagatgtacagcctcatcgacgagtacaagtt

SEQ ID NO: 1026 - DNA, 380 bp, Zea mays
cgcatgagattgctggagagcttcaggccaatcctgacctgatcatcggaaactacagtgacggaaaccttgttgcgtgtttgctcgcccacaagatgggtgttactcactgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatc

SEQ ID NO: 1027 - DNA, 419 bp, Zea mays
cactgccttccatcctgaaatcgaggagctcatctacagcgacgtcgagaactccgagcacaagttcgtgctgaaggacaagaagaagccgatcatcttctcgatggcgcgtctcgaccgcgtgaagaacatgacaggcctggtcgagatgtacggcaagaacgcgcgcctgagggagctggcgaacctcgtgatcgttgccggtgaccacggcaaggagtccaaggacagggaggagcaggcggagttcaagaagatgtacagcctcatcgacgagtacaagttgaagggccatatccggtggatctcggcgcagatgaaccgcgtccgcaacggggagctgtaccgctacatttgcgatacgaagggcgcattcgtgcagcctgcgttctacgaagcgttcggcctgactgtgatcg

SEQ ID NO: 1028 - DNA, 437 bp, Zea mays
  unsure (1)..(437): unsure at all n locations
cccacgcgtccggaaaccttgttgcgtgtttgctcgcccacaagatgggtgttactcactgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggcttgacctcctttcacccgagaatgangagctcctgtacagccaaaccgag

SEQ ID NO: 1029 - DNA, 425 bp, Zea mays
cctgaacgggcacatccgctggatctccgtccagatgaaccggtccgcaacggcgagggtagcgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgtacgggttctggaagtacgtgtccaacctggag

SEQ ID NO: 1030 - DNA, 431 bp, Zea mays
cgaccgtgtgaagaacttgactgggctggtggagctgtacggccggaacaagcggctgcgggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggcctgctcgt

SEQ ID NO: 1031 - DNA, 512 bp, Zea mays
  unsure (1)..(512): unsure at all n locations
agaaaaagtgtcngtgcctgcaccgctcgctancgcactactcactggttccaatatcgggggaggcggacgcgttcgaactgatcgagcagtacaacctgaacgggcacatccgctggatctccgcccagatgaaccgggtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgtacgggttctgggagtacgtg

SEQ ID NO: 1032 - DNA, 419 bp, Zea mays
  unsure (1)..(419): unsure at all n locations
gacaaggagagcatgtaccccttgctcaacttccttcgcgcccacaactacaaggggatgaccatgatgttgaacgacagaatccgcagtctcagtgctctgcaaggtgcgctgaggaaggctgaggagcacctgtccaccctacaagctgataccccatactctgaatttcaccacaggttccaggaacttggtctggagaagggttggggtgattgcgctaagcgtgcacaggagactatccacctcctcttggacctcctggaggccccagatccgtccaccctggagaagttccttggaacgatccccatggtgttcaatgtcgttatcctctcccctcatggntacttcgctcaagctaatgtcttgggttaccctgacaccggaggccaggttgtctacatcttggatcaagt

SEQ ID NO: 1033 - DNA, 421 bp, Zea mays
cccacgcgtccggaaatcgcgggaagcaaggacaccgtggggcagtacgagtcccacatcgcgttcactcttcctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgagaactccgagcacaagttcgtgctgaaggacaagaagaagccgatcatcttctcgatggcgcgtctcgaccgcgtgaagaacatgacaggcctggtcgagatgtacggcaagaacgcgcgcctgagggagctggcgaacctcgtgatcgttgccggtgaccacggcaaggagtccaaggacaggg

SEQ ID NO: 1034 - DNA, 421 bp, Zea mays
cggacgcgtgggagagtttgtaccccttgctgaacttcctcaaggctcataactacaagggcacgacgatgatgttgaatgacagaatccaaagccttcgtggtctccaatcatccctgagaaaggcagaggagtatctactgagtgttcctcaagacactccctactcggagttcaaccataggttccaagagcttggtttggagaagggttggggtgacactgcgaagcgtgtactcgacacactccacttgcttcttgaccttcttgaggcccctgatcctgccaacttggagaagttccttggaactataccaatgatgttcaatgttgttatcctttctcctcatggctacttcgctcagtccaatgtgcttggataccctgacactggcggtcaggttgtgtacattctggatca

SEQ ID NO: 1035 - DNA, 379 bp, Zea mays
  unsure (1)..(379): unsure at all n locations
ggcgcattcgtgcagcctgcgttctacgaagcgttcggcctgactgtgatcgagtccatgacgtgcggtctgccaacgatcgcgacctgccatggtggccctgctgagatcatcgtggacggggtatctggcctgcacattgacccttaccacagcgacaaggccgcggatatcctggtcaacttctttgacaaatgcaaggcagatccgagctactgggacaagatctcacagggcggcctgcagagaatttatgagaagtacacctggaagctctactccgagaggctgatgaccctgaccggcgtgtacgggttctggaagtacgtgagcaacctggagaggcgcgagacccgncgctacatcgagatgttctacg

SEQ ID NO: 1036 - DNA, 424 bp, Zea mays
ctcattgttaccaggctgttgcctgatgctgctgggactacgtgcggtcagcggctggagaaggtcattggtactgagcacacagacatcattcgcgttccgttcagaaatgagaatggcatcctccgcaagtggatctctcgttttgatgtctggccatacctggagacatacactgaggatgtttccagtgaaataatgaaagaaatgcaggccaagcctgaccttatcattggcaactacagcgatggcaacctagtcgccactctgctcgcacacaagttgggagtcactcagtgtaccatcgctcatgccttggagaaaaccaaataccccaactcggacatctacttggacaagttcgacagccagtaccacttctcttgccagttcacagctgaccttattgccatgaaccacactg

SEQ ID NO: 1037 - DNA, 447 bp, Zea mays
gacatgagtgtttactacccgtatacggaaaccgacaagagactcactgccttccatcctgaaatcgaggagctcatctacagcgacgtcgagaactccgagcacaagttcgtgctgaaggacaagaagaagccgatcatcttctcgatggcgcgtctcgaccgcgtgaagaacatgacaggcctggtggagatgtacggcaagaacgcgcgcctgagggagctggcgaacctcgtgatcgtcgccggtgaccacggcaaggagtccaaggacagggaggagcaggcggagttcaagaagatgtacagcctcatcgacgagtacaagttgaagggccatatccggtggatctcggcgcagatgaaccgtgtccgcaacggggagctgtaccgctacatttgtgataccaagggcgcattcgtgcaacctgcgttctacgaagcgttc

SEQ ID NO: 1038 - DNA, 409 bp, Zea mays
  unsure (1)..(409): unsure at all n locations
gtgcaacattgtctccctttagcatactgagtgtttactacccgtatacggaaaccgacaagagactcactgccttccatcctgaaatcgaggagctcatctacagcgacgtcgagaactccgagcacaagttcgtgctgaaggacaagaagaagccgatcatcttctcgatggcgcgtctcgaccgcgtgaagaacatgacaggcctggtcgagatgtacggcaagaacgcgcgcctgagggagctggcgaacctcgtgatcgttgccggtgaccacggcaaggagtccaaggacagggaggagcaagcggagttcaagaagatgtacagcctcatcgacgagtacaagttgaaaggccatatccggtggatctcggcgcagatgaaccgcgtncgcaacggggagct

SEQ ID NO: 1039 - DNA, 418 bp, Zea mays
atctcacagggcggcctgcagagaatctatgagaagtacacctggaagctctactccgagaggctgatgaccctgaccggcgtgtacgggttctggaagtacgtgagcaacctggagaggcgcgagacccgccgctacatcgagatgttctacgccctgaagtaccgtagcctggcaagccaggttccgctgtccttcgattagtacggggaaagaagaagaagaagaagcccaggccggagaaccatcgcctgcatttcgatctgtttcaccgcaattcgcattgttagtcgtgtattggagttatgtgtacttggtttccaagaactttggttccttctcgttttttttccttgtttgagcgtttttgggcagcgctggcctggttcctagtatggtgggaattggctgcaccttt

SEQ ID NO: 1040 - DNA, 439 bp, Zea mays
cccgtatacggaaaccgacaagagactcactgccttccatcctgaaatcgaggagctcatggacagcgacgtcgagaactccgagcacaagttcgtgctgaaggacaagaagaagccgatcatcttctcgatggcgcgtctcgaccgcgtgaagaacatgacaggcctggtggagatgtacggcaagaacgcgcgcctgagggagctggcgaacctcgtgatcgtcgccggtgaccacggcaaggagtccaaggacagggaggagcatgctgagttcaagaagatgtacagcctcatcgacgagtacaagttgaagggccatatccggtggatctcggcgcagatgaaccgggtccgcaaacgggagctgtaccgctacatttgtgataccaagggcgcattccggcagcctgcgttctacgaagcgttcggcctgact

SEQ ID NO: 1041 - DNA, 392 bp, Zea mays
ctccgaagatcctcattgttaccaggctgttgcctgatgctgctgggactacgtgcgggcagcggctggagaaggtcattggtactgagcacacagacatcattcgcgttcccttcagaaatgagaatggcatcctccgcaagtggatctctcgttttgatgtctggccatacctggagacatacactgaggatgtttccagtgaaataatgaaagaaatgcaggccaagcctgaccttatcattggcaactacagcgatggcaacctagtcgccactctgctcgcgcacaagttgggagtcactcagtgtaccatcgctcatgccttggagaaaaccaaataccccaactcggacatatacttggacaaattcgacagccagtaccacttc

SEQ ID NO: 1042 - DNA, 418 bp, Zea mays
cgcgtctcgaccgcgtgaagaacatgacaggcctggtggagatgtacggcaagaacgcgcgcctgagggagctggcgaacctcgtgatcgtcgccggtgaccacggcaaggagtccaaggacagggaggagcatgcggagttcaagaagatgtacagcctcatcgacgagtacaagttgaagggccatatccggtggatctcggcgcagatgaaccgcgtccgcaacggggagctgtaccgctacatttgcgataccaagggcgcattcgtgcagcctgcgttctacgaagcgttcggcctgactgtgatcgagtccatgacgtgcggtctgccaacgatcgcgacctgccatggtggccctgctgagatcatcgtggacggggtatctggcctgcacattgacccttaccacagcga

SEQ ID NO: 1043 - DNA, 436 bp, Zea mays
  unsure (1)..(436): unsure at all n locations
gccaggcggacccgagccactggagcaagatctcccagggcgggctccagcgtagcgaggagaagtacacctggaagctctactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagccctccagcaagtgatgcgcgacggcggccacagacctgatcgatcgatgagcgagagggagcactcggagtgtcgtgtcttttcccttgccatttctttctttttttcccttcccggaggcgaaaaaaagagtctgcttttgctaggcggcgggcgttcgttgctgctctttgcttcaagagttaaatntacctacctt

SEQ ID NO: 1044 - DNA, 376 bp, Zea mays
gtttgtaccccttgctgaacttcctcaaggctcataactacaagggcacgacgatgatgttgaatgacagaatccaaagccttcgtggtctccaatcatccctgagaaaggcagaggagtatctactgagtgttcctcaagacactccctactcggagttcaaccataggttccaagagcttggcttggagaagggttggggtgacactgcgaagcgtgtactcgacacactccacttgcttctcgaccttctggaggcccctgatcctgccaacttggagaagttccttggaactataccaatgatgttcaacgttgttatcctgtctcctcatggctacttcgcccagtccaatgtgcttggataccctgacac

SEQ ID NO: 1045 - DNA, 412 bp, Zea mays
ctccgaagatcctcattgttaccaggctgttgcctgatgctgctgggactacgtgcggggatcggctggagaaggtcattggtactgagcacacagacatcattcgcgttcccttcagaaatgagaatggcatcctccgcaagtggatctctcgttttgatgtctggccatacctggagacatacactgaggatgtttccagtgaaataatgaaagaaatgcaggccaagcctgaccttatcattggcaactacagcgatggcaacctagtcgccactctgctcgcgcacaagttgggagtcactcagtgtaccatcgctcatgccttggagaaaaccaaataccccaactcggacatatacttggacaaattcgacagccagtaccacttctcttgccagttcacagctga

SEQ ID NO: 1046 - DNA, 424 bp, Zea mays
ggcaactacagcgatggcttcctagttctcactctgctcgcacacaagttgggagtgactcagtgtaccatcgctcatgccttggagaaaaccaaataccccaactcggacatctacttggacaagttcgacagccagtaccacttctcttgccagttcacagctgaccttattgccatgaaccacactgatttcatcatcaccagcacattccaagaaatcgcgggaagcaaggacaccgtggggcagtacgagtcccacatcgcgttcactcttcctgggctctaccgtgtcgtccatggcatcgatgttttcgatcccaagttcaacattgtctcccctggagcagacatgagtgtttactacccgtatacggaaaccgacaagagactcactgcctttcatcctgaaatcgaggagctca

SEQ ID NO: 1047 - DNA, 433 bp, Zea mays
gaagatgtttgacctcatcgagcagtacaacctgaacgggcacatccgctggatctgggcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctgtaagctctactcggagaggctgatgaccctaacggcgtgtacgggttct

SEQ ID NO: 1048 - DNA, 447 bp, Zea mays
  unsure (1)..(447): unsure at all n locations
ctgatcctgccaacttggagaagttccttggaactataccaatgatgttcaatgttgtgatccgttctcctcatggctacttcgctcagtccaatgtgcttggataccctgacactggcggtcaggttgtgtacattctggatcaagtccgtgctttggagaatgagatgcttctgaggattaagcagcaaggccttgatatcactccgaagatcctcattgttaccaggctgttgcctgatgctgctgggactacgtgcggtcagcggctggagaaggtcattggtactgagcacacagacatcattcgcgttccgttcagaaatgagaatggcatcctccgcaagtggatctctcgttntgatgtctggccatacctggagacatacactgaggatgtttccagtgaaataatgaaagaaatgcaggccaagcctgaccttatca

SEQ ID NO: 1049 - DNA, 383 bp, Zea mays
acctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccaaggcgggcttcaacgtatcgaggagaagtacacctggaagctttac

SEQ ID NO: 1050 - DNA, 278 bp, Zea mays
gtgtgggtagcctgcgttctacgaagcgttcggcctgactgtgatcgagtccatgacgtgcggtctgccaacgatcgcgacctgccatggtggccctgctgagatcatcgtggacggggtatctggcctgcacattgacccttaccacagcgacaaggccgcggatatcctggtcaacttctttgacaaatgcaaggcagatccgagctactgggacaagatctcacagggcggcctgcagagaatctatgagaagtacacctggaagctctactccg

SEQ ID NO: 1051 - DNA, 408 bp, Zea mays
aagatgtacagcctcatcgacgagtacaagttgaagggccatatccggtggatctcggcgcagatgaaccgcgtccgcaacggggagctgtaccgctacatttgcgatacgaagggcgcattcgtgcagcctgcgttctacgaagcgttcggcctgactgtgatcgagtccatgacgtgcggtctgccaacgatcgcgacctgccatggtggccctgctgagatcatcgtggacggggtatctggcctgcacattgacccttaccacagcgacaaggccgcggatatcctggtcaacttctttgacaaatgcaaggcagatccgagctactgggacaagatctcacagggcggcctgcagagaatctatgagaagtacacctggaagctctactccgagaggctgatg

SEQ ID NO: 1052 - DNA, 434 bp, Zea mays
ccagttcacagctgaccttattgccatgaaccacaccgatttcatcatcaccagcagattccaagaaatcgcgggaagcaaggacaccgtggggcagtacgagtcccacatcgcgttcactcttcctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgagaactccgagcacaagttcgtgctgaaggacaagaagaagccgatcatcttctcgatggcgcgtctcgaccgcgtgaagaacatgacaggcctggtcgagatgtacgggaagaacgcgcgcctgagggagctggcgaacctcgtga

SEQ ID NO: 1053 - DNA, 439 bp, Zea mays
agaacgcgcgcctgagggagctggcgaacctcgtgatcgttgccggtgaccacggggaggagtccaaggacagggaggagcaggcggagttcaagaagatgtacagcctcatcgacgagtacaagttgaagggccatatccggtggatctcggcgcagatgaaccgcgtccgcaacggggagctgtaccgctacatttgcgatacgaagggcgcattcgtgcagcctgcgttctacgaagcgttcggcctgactgtgatcgagtccatgacgtgcggtctgccaacgatcgcgacctgccatggtggccctgctgagatcatcgtggacggggtatctggcctgcacattgacccttaccacagcgacaaggccgcggatatcctggtcaacttctttgacaaatgcaaggcagatccgagctactgggacaagatctc

SEQ ID NO: 1054 - DNA, 416 bp, Zea mays
cggacgcgtggggttgcctgatgctgctgggactacgtgcggtcagcggctggagaaggtcattggtactgagcacacagacatcattcgcgttcccttcagaaatgagaatggcatcctccgcaagtggatctctcgttttgatgtctggccatacctggagacatacactgaggatgtttccagtgaaataatgaaagaaatgcacgccaagcctgaccttatcattggcaactacagcgatggcaacctagtcgccactctgctcgcgcacaagttgggagtcactcagtgtaccatcgctcatgccttggagaaaaccaaataccccaactcggacatatacttggacaaattcgacagccagtaccacttctcttgccagttcacagctgaccttattgccatgaaccaca

SEQ ID NO: 1055 - DNA, 375 bp, Zea mays
atcgatgttttcgatcccaagttcaacattgtctcccctggagcagacatgagtgtggactacccgtatacggaaaccgacaagagactcactgccttccatcctgaaatcgaggagctcatcaacagcgacgtcgagaactccgagcacaagttcgtgctgaaggacaagaagaagccgatcatcttctcgatggcgcgtctcgaccgcgtgaagaacatgacaggcctggtggagatgtacggcaagaacgcgcgcctgagggagctggcgaacctcgtgatcgtcgccggtgaccacggcaaggagtccaaggacagggaggagcatgcggagttcaagaagatgtacagcctcatcgacgagtacaagttg

SEQ ID NO: 1056 - DNA, 387 bp, Zea mays
atgaaccacaccgatttcatcatcaccagcacattccaagaaatcgcgggaagcaaggacaccgtggggcagtacgagtcccacatcgcgttcactcttcctgggctctaccgtgtcgtccatggcatcgatgttttcgatcccaagttcaacattgtctctcctggagcagacatgagtgtttactacccgtatacggaaaccgacaagagactcactgccttccatcctgaaatcgaggagctcatctacagcgacgtcgagaactccgagcacaagttcgtgctgaaggacaagaagaagccgatcatcttctcgatggcgcgtctcgaccgcgtgaagaacatgacaggcctggtggagatgtacggcaagaacgcgcgcctg

SEQ ID NO: 1057 - DNA, 383 bp, Zea mays
gagaatggcatcctccgcaagtggatctctcgttttgatgtctggccatacctggagacgtacgctgaggatgtttccagtgaaataatgaaagaaatgcaggccaagcctgaccttatcattggcaactacagcgatggcaacctagtcgccactctgctcgcgcacaagttgggagtcactcagtgtaccatcgctcatgccttggagaaaaccaaataccccaactcggacatctacttggacaagttcgacagccagtaccacttctcttgccagttcacagctgaccttattgccatgaaccacaccgatttcatcatcaccagcacattccaagaaatcgcgggaagcaaggacaccgtggggcagtacgaggtcca

SEQ ID NO: 1058 - DNA, 360 bp, Zea mays
cccacgcgtccgctgtaccgctacatctgcgaacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgtaccggttctg

SEQ ID NO: 1059 - DNA, 404 bp, Zea mays
  unsure (1)..(404): unsure at all n locations
acgcccacgcgtccgcccacgcgtccgtcgaggagtacaagttgaagggccatatccgggggatgtctnctcagatgagccgcgtccgcaacggggagctgtaccgctacatttgcgatacgaagggcgcattcgtgcagcctgcgttctacgaagcgttcggcctgactgtgatcgagtccatgacgtgcggtctgccaacgatcgcgacctgccatggtggccctgctgagatcatcgtggacggggtatctggcctgcacattgacccttaccacagcgacaaggccgcggatatcctggtcaacttctttgacaaatgcaagggagatccgagctactgggacaagatctcacagggcggcctgcagagaatctatgagaagtacacctggaagctctac

SEQ ID NO: 1060 - DNA, 424 bp, Zea mays
gcgacaaggccgcggatatcctggtcaacttctttgacaaatgcaaggcagatccgagctagtgggacaagatctcacagggcggcctgcagagaatctatgagaagtacacctggaagctctactccgagaggctgatgaccctgaccggcgtgtacgggttctggaagtacgtgagcaacctggagaggcgcgagacccgccgctacatcgagatgttctacgccctgaagtaccgtagcctggcaagccaggttccgctgtccttcgattagtacggggaaagaagaagaagaagaagcccaggccggagaaccatcgcctgcatttcgatctgtttcaccgcaattcgcattgttagtcgtgtattggagttatgtgtacttggtttccaagaactttggttccttctcgtatattttcc

SEQ ID NO: 1061 - DNA, 337 bp, Zea mays
gtcgcattcgtgcagcctgcgttctacgaagcgttcggcctgactgtgatcgagtccatgacgtgcggtctgccaacgatcgcgacctgccatggtggccctgctgagatcatcgtggacggggtatctggcctgcacattgacccttaccacagctgacaaggccgctgatatcctggtcaacttctttgacaaatgcaaggcagatccgagctactgcgacaagatctcacagggcggcctgcagagaatctatgacaagtgcacctggaagctctactccgagaggctgatgaccctgaccggcgtgtacgggttctggaagtacgtgagcaac

SEQ ID NO: 1062 - DNA, 384 bp, Zea mays
atcaacagcgacgtcgagaacttcgagcacaagttcgtgctgaaggacaagaagaaggcgatcatcttctcgatggcgcgtctcgaccgcgtgaagaacatgacaggcctggtggagatgtacggcaagaacgcgcgcctgagggagctggcgaacctcgtgatcgtcgccggagaccacggcaaggagttcaaggacagggaggagcaggcggagttcaagaagatgtacagcctcatcgacgagtacaagttgaagggccatatccggtggatctcggcgcagatgaaccgcgtgcgcaacggtgagctgtaccgttacatttgcgataccaagggcgcattcgtgcagcctgcgttctacgaaacgttcggcctgactgtg

SEQ ID NO: 1063 - DNA, 413 bp, Zea mays
ggcaacccttccaaggacaaggaggagcatgccgagttcaagaagatgtttgacctcatggagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccatggcgggctccagcgtatcgagga

SEQ ID NO: 1064 - DNA, 306 bp, Zea mays
gcgggaagcaaggacaccgtggggcagttcgagtcccacatcgcgttcactcttgctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtccagaactccgagcacaagttcgtgctgaaggacaagaagaagccgatcatcttctcgatggcgcgtctcgaccgcgtgaagaacatgaca

SEQ ID NO: 1065 - DNA, 379 bp, Zea mays
ggacaccgtggggcagtacgagttcctgattgtgtttactcttcctgggctctagcgcgtggtccatggcatcgatgttttcgatcccaagttcaacattgtctcccctggagcagacatcactgtttactacccgtatacggaaaccgacaagagactcactgccttgcatcctgaaatcgaggagctcatctacagcgacttcgataactccgagcacaatttcatgctgaaggactacatgatgccgatcatcttctcgatggcgcgtctataccgcgtgaagaacatgactggcctgatcgagatgtacggcatgatcgcgcgcctgagggagctgtcgaacctcgtgatcgttgccggtgaccactgcaaggag

SEQ ID NO: 1066 - DNA, 352 bp, Zea mays
gcgcagatgaaccgcgtccgcaacggggagctgtaccgctacatttgcgatacgaagggcgcattcgtgcagcctgcgttctacgaagcgttcggcctgactgtgatcgagtccatgacgtgcggtctgccaacgatcgcgacctgccatggtggccctgctgagatcatcgtggacggggtatctggcctgcacattgacccttaccacagcgacaaggccgcggatatcctggtcaacttctttgacaaatgcaaggcagatccgagctactgggacaagatctcacagggcggcctgcagagaatctatgagaagtacacctggaagctctactccgagaggctgatga

SEQ ID NO: 1067 - DNA, 326 bp, Zea mays
gaaatcgaggagctcatcaacagcgacgtcgagaactccgagcacaagttcgtgctgaaggacaagaagaagccgatcatcttctcgatggcgcgtctcgaccgcgtgaagaacatgacaggcctggtggagatgtacggcaagaacgcgcgcctgagggagctggcgaacctcgtgatcgtcgccggtgaccacggcaaggagtccaaggacagggaggagcaggccgagttcaagaagatgtacaggctcatcgacgagtacaagttggagggccatatccggtggatctaggcgcagatgaaccgggttccgcacggggagct

SEQ ID NO: 1068 - DNA, 251 bp, Zea mays
acttcccgtacaccgagtcgcacaagaggttgacctcccttcactcggagattgaggagcgtcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaaccc

SEQ ID NO: 1069 - DNA, 424 bp, Zea mays
ctggaagctctactcggagaggctgatgaccctcaccggcgtgtacgggttctggaagggcgtgtccaacctggagaggcgcgagacccggcggtacctggagatgctgtacgcgctcaagtaccgcaccatggcgagcaccgtgccgctggccgtggagggagagccctccagcaagtgatgcgcgacggcggccacagacctgatcgatcgatgagcgagagggagcactcggagtgtcgtgtcttttcccttgccatttctttctttatttcccttcccggaggcgaaaaaaagagtctgcttttgctacgcggcggtcgttcgttgctgctctttgcttcaagagttaaatttacctaccttgtcaaggtcttgatccatcattgatcccagtgacgctatgttaggagtctgatggact

SEQ ID NO: 1070 - DNA, 421 bp, Zea mays
cccacgcgtccgctggaagctctactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagccctccagcaagtgatgcgcgacggcggccacagacctgatcgatcgatgagcgagagggagcactcggagtgtcgtgtcttttcccttgccatttctttctttttttcccttcccggaggcgaaaaaaagagtctgcttttgctaggcggcgggcgttcgttgctgctctttgcttcaagagttaaatttacctaccttgtcaaggtcttgttccatcattgatccgggtgtcgctttttta

SEQ ID NO: 1071 - DNA, 342 bp, Zea mays
  unsure (1)..(342): unsure at all n locations
accgagtcgcacaagaggctgacctcccttcacccggagattgaggagctcctgtacagccgaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatncgctggatctccgnccagatgaac

SEQ ID NO: 1072 - DNA, 480 bp, Zea mays
  unsure (1)..(480): unsure at all n locations
ttactatgcagagcggtgttgtcctacngccancgcccgtccgcaaacacaacangggaataacaataagtttaaccaacaaaaccggaatcccaattgcccggcaaggtcccctaaggaaggctaaggaccaccggtcaaccctacaggctgatacccaaaaccctgaatttcaccacaggttcaaggaacttggcctggaaaagggttggggtgattgccctaagcgtgcaaaggaaactatccacctcctcttggacctcctggaggccccagatccgtccaccctggagaagttccttggaacgatccccatggtgttcaatgtcgttatcctctcccctcatggttacttcgctcaagctaatgtcttgggttaccctgacaccggaggccaggttgtctacatcttggatcaagtgcgcgctatggagaacgaaatgctgctgaggatcaagcagtgtggtcttgacatcacgc

SEQ ID NO: 1073 - DNA, 420 bp, Zea mays
cccacgcgtccgcaagatctcacagggcggcctgcagagaatctatgagaagtacaggtggaagctctactccgagaggctgatgaccctgaccggcgtgtacgggttctggaagtacgtgagcaacctggagaggcgcgagacccgccgctacatcgagatgttctacgccctgaagtaccgtagcctggcaagccaggttccgctgtccttcgattagtacggggaaagaaggagaagaagaagaagaagcccaggccggagaaccatcgcctgcatttcgatctgtttcaccgcaattcgcattgttagtcgtgtattggagttatgtgtacttggtttccaagaactttggttccttgtttttttttctttcttgtttgagcgtttttgggcagcgctggcctggttcctagtatg

SEQ ID NO: 1074 - DNA, 394 bp, Zea mays
actgcgacctctactggaagaagtttgagttatcacttccacttctcgtgccagttcaccggtgacggtgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctactttccgtacaccgagtcgcacaagaggctgaccttccttcacccggagattgaagagcttctgtacagccaaaccgagaacacggagcacaagttccgttctgaacgacaggaacaagccaatcattttttc

SEQ ID NO: 1075 - DNA, 403 bp, Zea mays
cccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgctgcgaccatggcaacccttccaaggacaaggtggagcaggccgagttcaagaagatgtttgacctcatcgagcattacaacctgaacgggcacattcgttggatcttcgcccatatgaactcgcgtccgtaacggcgagctgttccgttacatttgctacaccaaggtctctag

SEQ ID NO: 1076 - DNA, 353 bp, Zea mays
  unsure (1)..(353): unsure at all n locations
ctgacgcatgggcacgtttgccggatcgtactgcgggccggccgagatcatcgtgcgcngggtgtctagcggcggcatggacccttaccagggctacaaggcgtcggccctgctcgtggacttcttcgacaagtgccaggcggacccgagccactggagcaagatctcccatggcgggctccagcgtatcgaggagaagtacacctggaagctctactcggagaggctgatgaccctcaccggcgtgtacgggttctggaagtacgtgtccaacctggagaggcgcgagacccgacggtacctggagatgctgtacgcgctcaagtaccgcaccatggcgagcaccgtgccgc

SEQ ID NO: 1077 - DNA, 253 bp, Zea mays
acgaacgttcggcctgactgtgatcgagtccatgacgtgcggtctgccaacgatctgtaccggccatggtggccctgctgagatcatcgtggacggggtatctggcctgcacattgacccttaccacagcgacaaggccgcggatatcctggtcaacttctttgacaaatgcaagggagatccgagctactgggacaagatctcacatggcggcctgcagagaatctatgagaagtacacctggaatctctac

SEQ ID NO: 1078 - DNA, 298 bp, Zea mays
ctttttcctttccggtggcgaattttttgtagtctgcttttgctaggcggcgggcgttcgttgctgctctttgcttcaagagttaaatttacctaccttgtcaaggtcttgttccatcattgatccgggtgtcgcttttagtagtctgatggactgttagtagtttgcgttgcgtcggttgagagggaacggtggtggtggtggtgtgtgtgcagtcgggtgtggtgctccctttgtttcctggatgggatgttgctccttgaataataatcgtagtggccttggagcccttttcctg

SEQ ID NO: 1079 - DNA, 256 bp, Zea mays
ccttgttgcgtgtttgctcgcccacaagatgggtgttactcactgtaccattgcccaggcggttgagaaaactaagtagcctaactccgacctctactggaagaagtttgaggatcactaccacttctcgtgccagttcaccactgacttgattgcaatgaaccatgccgacttcatcatcaccagtaccttccaagagatcgccggaaacaaggacaccgtccgccaatacgagtcacacatggcgttcacaatg

SEQ ID NO: 1080 - DNA, 151 bp, Zea mays
gcctggtcgagatgtacggcaagaactctcgcctgagggagctggcgaacctcgtgagcgttgccggcgaccacggcaaggagtccaaggacagggaggagcaggcggagttcaagaagatgtacagcctcatcgacgagtccaagttgaa

SEQ ID NO: 1081 - DNA, 208 bp, Zea mays
atcgttcgcaagtggatctcgcgatttgaagtctggccgtacctggagacttacactgatgacgtggcgcatgagattgctggagagcttcaagccaatcctgacctgatcatcggaaactacagtgacggaaaccttgttgcgtgtttgctcgcccacaagatgggtgttactcactgtaccattgcccatgcgcttgaaaaactaa

SEQ ID NO: 1082 - DNA, 240 bp, Zea mays
cggacgcgtgggcggacgcgtggggtttactacccgtatacggaaaccgacaagagactgactgccttccatcctgaaatcgaggagctcatctacagcgacgtcgagaactccgagcacaagttcgtgctgaaagacaagaagaagccgatcatcttctcgatggggcgtcttgaccccgtgaagaacatgacaaggctgggcgagatgtacggcaagaacccgcgcctgaaggagctg

SEQ ID NO: 1083 - DNA, 393 bp, Zea mays
gaggagctggcgaacctcgtgatcgttgccggtgaccacggcaaggagtccaagggcagggatgagcaggcggagttcaagaagatgtacagcctcatcgacgagtacaagttgaagggccatatccggtggatctcggcgcagatgaaccgcgttcgcaacggggaactgtaccgctacatttgcgattcgaaaggcgcatttcgtgccagctgcgttcttcgaaacggtcgggctgactgggatcgaatccatgacgtgcggtctgccaacgatcgcgaccttccatggtgggccctctgaaaatatcgtggactgggtatttggcctggacattgaccctttccacagcgacaaggccttggatattccggttaacgtttttgaccaatg

SEQ ID NO: 1084 - DNA, 318 bp, Zea mays
gggatgttgctccttgaataataatcgtagtggccttggagcccttttcctgaaataagagcagcatcctagtgcttcactttgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggaatcaaatcaaaaatatcaaaacttaaaaaaattaataagaaataaaaaaaatatactaatgattaaccaaaataaaaacaaatatcaatttattaaaaactcaaacaaggaaaaa

SEQ ID NO: 1085 - DNA, 451 bp, Zea mays
agcagacatgagtgtgtactacccgtatacggaaaccgactagagactcactgccttccatcctgaaatcgaggagctcatctacagcgacgtcgagaactccgagcacaagttcgtgctgaaggacaagaagaagccgatcatcttctcgatggcgcgtctcgaccgcgtgaagaacatgacaggcctggtcgagatgtacggcatgaacgcgcgcctgagggagctggcgaacctcgtgatcgttgccggtgaccactgcaaggagtccaaggacagggaggagcaggcggagttcaagaagatgtacagcctcatcgacgagtacaagttgaagggccatatccggtggatctcggcgcagatgaaccgcgtccgcaacggggagctgtaccgctacatttgcgatacgaagggcgcattcgtgcagcctgcgttctacgaagcgttc

SEQ ID NO: 1086 - DNA, 351 bp, Zea mays
gctagctctctgttgaccattgcgtattctgaaccatcgagccatggctgccaagcgtactggcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcacgaagcaattgtgctccccccatgggttgcacttgctatcaggccaaggcctcgtgtctgggattacattcgggtgaatgtaagtgagcttgc

SEQ ID NO: 1087 - DNA, 220 bp, Zea mays
gcacgaggccaggcgacgagcgccggtcggtcgtcgccatcgacggcggcctgttcgagcactacgccgagttcaggaagcgcctggaggccacgctggtggagctgctcggggaggaggcgtctaggctggtggaggtcaagctcaccaaggacgggtctggcctcggagccgccctcattgcagctgcccactcgcagtactgaacgcccaacggccg

SEQ ID NO: 1088 - DNA, 313 bp, Zea mays
cggagatgcgcgccggactgcgcaggacggcggcagcaagatcaagatgatcgtctccttcgtcgacaacctccccacggggaacgaagagggcgtcttctacgccttggaccttggcggaacgaacttccgcgtgctgcgcgtgcagctggccgggaaggacaggcgtgtgtgcaagcgagagtccaaggaggtgtccatccctcctcacctcatgtcaggcaacgcatcggagctgtttggcttcatcgcctcggcgctagctaagtacgtcgccgcggcgggcgaaagggacggcaagcagagagagctc

SEQ ID NO: 1089 - DNA, 314 bp, Zea mays
gttcatctccatgccgacctgactcggactcttgatttgctcctcgcgggggttcggtcccatggcggcagctgcgctggcaatggcagagcaggtggtggccgagctccgagtgaggtgtgagacgccgccgtcgatgctgcgcgaggtggccgtggagatggcccgcgagatgggcgcggggctggagaaggacggcgggagcagggtcaagatgctcctctcctacgtcgataagctccccacagggagagaggaaggattattctatggattgaccctaggaggaacgaatttccgcgtcttgaaagtgc

SEQ ID NO: 1090 - DNA, 286 bp, Zea mays
ctcgcttcagtcttaggtatttttatgtctctcttttatttcgagagttgcctgttccatatggaaaaaaaaaacgagagttaatgctgatcaaacagacgttgctgctgcgtttggcattcaggactccggacatctccgcgatgcaccatgacggcacgcctgacctgagagtcgtggcggagaagctggccgacaacctcagggtcagggacacgtccttggacacgaggaagatggtggtcgagatctgcgacatcgtcaccgggaggtctgcccggctggc

SEQ ID NO: 1091 - DNA, 271 bp, Zea mays
cttacaaactctggtggcatggtagtaaacatggaatggggcagtttctggtcatcacatttgccaagaactccttatgacatctcccttgatgatgagacacaaaaccgcaatgatcaggggtttgagaaaatggtctctgggatttatcttggggaaattgcaaggctggtgctgcatcgaatggctctagaatcagattttcttggtgacgctgctgataatctatgtacccccttcacattgagcacaccactcctcgctgcaattc

SEQ ID NO: 1092 - DNA, 266 bp, Zea mays
caaagacaaattgctaggtgactttagccaacaaaggactgtagttgctattgacggtggcctatacgagcactacaagaagttcagtgcctgcctagaggcgacgctcacagacctgctcggcgaggaggttgcctcatcggttgttgtcaagttggccaacgacggctcaggaattggagctgcacttcttgctgcttcgcactcccagtatgctgaagctgcatagttctaggagctcgggggtcctagtgtaaccttttttt

SEQ ID NO: 1093 - DNA, 307 bp, Zea mays
  unsure (1)..(307): unsure at all n locations
ccgcgatgcaccatgacggcacgcctgacctgagagtcgtggcggagaagctggccgacaacctcagggtcagggacacgtccttggacacgaggaagatggtggtcgagatctgcgacatcgtcaccgggacgtctgcacggctggccgcggcggggatcgtcgggatcctcaggaagatcggtcgagcggcgccaggcgacgagcgccggtacgtcgtcgcgatcgacggcggcctgttcgagcactacgccgagttcagggaagcgcctgtagccacgcntagtgagctgctcgggggagagcg

SEQ ID NO: 1094 - DNA, 260 bp, Zea mays
cccacgcgtccgcccacgcgtccggataaatccttagacttcgaaagtttgaaccctggtgagcagatatatgaaaagatgatttctggaatgtatcttggagaaattgtccggaggatcctgctgaaactggctcatgatgcttcattgtttggggatgttgttcctccgaaactggaacagctatttatactgaggacgccagatatgtcagccatgcaccatgacacctcacatgatctcaaacacctgggagctaa

SEQ ID NO: 1095 - DNA, 277 bp, Zea mays
gaagataggccgggacaaagtaccaagcagtggcagtaaaatgccaaggactgtaattgccttggatggtgggctctatgagcattacaagaagttcagcagctgcgtcgaagcaactcttacagacttgctcggcgaagaggcctcttcctccgtggttgccaagctggccaacgatggctctggcattggagctgctctccttgcagcctcacactcccagtatggcgagagtgactagtcttgaaaaccggtgtggatcgaacttcgagtgtag

SEQ ID NO: 1096 - DNA, 206 bp, Zea mays
gcagcatatgtggagcatgcaaatgcaattcctaaatggacggggttactgcctaaatctggaaacatggtaattaatacggaatggggaagctttaaatccggcaagcttcctctctcagaatacgacaaagccatggactttgaaagtttgaaccctggagagcagatatacgaaaaaatgatctctggcatgtatctgggaga

SEQ ID NO: 1097 - DNA, 343 bp, Zea mays
  unsure (1)..(343): unsure at all n locations
ggcattagtcaatgatacagtgggcacattggctggtgggagatatatggataccgatgtagttgcagctgtaatattnggcactggtacaaatgcagcatatgtggagcatgcaaatgcaattcctaaatggactgggttactgcctaaatctggaaagatggtanttaatacagagtgggggagcttcaaatccaacaaacttcctctttcagaatatgacaaagncancnnncttgaaagtttgaacctggagagcagatattacgagaaatgnttctggtatgtactcggagagattgttcgaagaatntactgaantggccatgagctctctattggg

SEQ ID NO: 1098 - DNA, 257 bp, Zea mays
gggtttttgattgaagatgtggttgggaaagatgtggctcaatgcttaaatgaagctcttgctaggagtggactaaatgtgcgagttactgcactggtgaatgacactgtggggacgttagctctaggtcattatcacgatgaggatacagtggctgctgtgataatcggtgctggcaccaatgcttgctatatcgaacgcactgatgcaattattaaatgtcagggtcttcttacaaactctggtggcatggttgt

SEQ ID NO: 1099 - DNA, 286 bp, Zea mays
gactagatgtacggtagtagctcggaatcggctgagcaaaacctgggcgctaagctgaaggacattcttggggttcctgatacttctctggacgcaagatacatcactcttcatgtgtgcgaccttgtcgcagagagaagtgcacgcctggctgctgctggtatatatcgtattctgaagaagctgggtaaagacaaattgctaggtgactgatacaaacaaaggactgtagttgctattgacggtggcctatacgagcactacaagaagttcagtgcctgcctag

SEQ ID NO: 1100 - DNA, 254 bp, Zea mays
gaaacatctgatctgaagattgtggccgaaaattttgaacaaaacctagagattacaggcacatccttggaggctcgtaagctggtcgttgaaatctgtgacattgtggcgacaagagcagcccggctggctgctgcggggcttgcagggatcctcatgaagatcgggagagatcacagcgtcgaggaccaacggtcagtcatcgccatcgacggaggactgttcgagcactacaccaaattccgccggtgctt

SEQ ID NO: 1101 - DNA, 303 bp, Zea mays
  unsure (1)..(303): unsure at all n locations
tctcccttgatgatgagacgcaaaatcgcaatgatcaggggtttgaaaaaatgatatctgnggatttatcttggggaaattgcaaggctggtgctgcatcgaatggctctagaatcagatgtctttggtgatgccgctgataatctatcaaccccttcacattgagcacaccacttctggctgcaattcgcaaggacgattcaccagatctgagcgaagtcagaaggatattgcaagaccatctgaagataccggacactcctctgacaactcggaagctagtcgtcaaagtctgcgacatcg

SEQ ID NO: 1102 - DNA, 263 bp, Zea mays
gtttgttgacgatgatgagaagtgcgctaacatttcgaatggcaagaagcgagatctagggttcacgttttcgttcccagtgaagcagcgttctgtagcttccggtacgcttgtcaagtggacaaaggcattttccattaatgatgctgtaggcgaagatgtggtggctgaactgcaaacagccatggagaagcaaggtctggacatgcatgtagctgcattgattaatgatgctgttgggacgctggcgggagcaaggtact

SEQ ID NO: 1103 - DNA, 270 bp, Zea mays
ctttgttgacgatgatgagaagtgcgctaacatttcgaatggcaagaagacgagtctagggttcacgttttcgttcccagtgaagcagcgttctgtagcttccggtacgcttgtcaagtggacaaaggcattttccattaatgatgctgtaggcgaagatgtggtggctgaactgcaaacagccatggagaagcaaggtctggacatgcatgtagctgcattgattaatgatgctgttgggacgctggcgggagcaaggtactacgacaa

SEQ ID NO: 1104 - DNA, 279 bp, Zea mays
gcgtcgaggaccaacggtcagtcatcgccatcgacggaggactgttcgagcactacaccaaattccgccggtgcttggagaccacactgggtgagctgctaggagacgaggcgtccaaggcggtggccatcaagcatgccgatgacggctcaggaataggtgctgccctgattgcagcttcacagtctcagtacaaaaacgacttagtggccgtcaagcatgcagatgacggttcaggagtcaagtatgcagaagacaagcgtgcagatgacggttcag

SEQ ID NO: 1105 - DNA, 349 bp, Zea mays
tggcgacaagagcagcccggctggctgctgcggggcttgcagggatcctcatgaagatcgggagagatcacagcgtcgaggaccaacggtcagtcatcgccatcgacggaggactgttcgagcactacaccaaattccgccggtgcttggagaccacactgggtgagctgctaggagacgaggcgtccaaggcggtggccatcaagcatgccgatgacggctcaggaataggtgctgccctgattgcagcttcacagtctcagtacaaaaacgacttagtggccgtcaagcatgcaatgacggttcaggagtcaagtatgcagaagacaagcgtgcagatgacggttca

SEQ ID NO: 1106 - DNA, 338 bp, Zea mays
ctttcgtgtcatccgggtccaacttggcggaagggacagacgtgtcgtgaagccacagtatgaagaggtctccattccgcctcatcttatggttggaacttctacggaactatttgatttcattgctgctgagttggaaaaatttgtgcggactgaaggagaagatttccacctaccagatagcaagcagagggaactgggtttcaccttttctttcccagtgcaccaaacatctatatcatcggggactctaattaagtggaccaaaggattttgcatcaatggcacggttggagaagatgttgtggctgaattgagtagggccatggaaaggcagg

SEQ ID NO: 1107 - DNA, 263 bp, Zea mays
agcagagggaactgggtttcaccttttctttcccagtgcaccaaacatctatatcatcggggactctaattaagtggaccaaaggattttgcatcaatggcacggttggagaagatgttgtggctgaattgagtagggccatggaaaggcagggtcttgatatgaaagttgcagctctggttaatgatactgtaggcacattggctggtgggagatatgctgataatgatgttgttgctgctgtaatattgggcactggcaca

SEQ ID NO: 1108 - DNA, 119 bp, Zea mays
gatttccacctaccagatggcaagcagagggaactgggtttcaccttttctttcccagtgcaccaaacatctatatcatcggggactctaattaagtggaccaaaggcttttgcatcaa

SEQ ID NO: 1109 - DNA, 277 bp, Zea mays
  unsure (1)..(277): unsure at all n locations
caggaacactcatcaagtggacaaagggcttttccatcaatggcacggttggtgaagatgttgtttctgagttgagcagggccatggagaggcagggactagatatgaaagctacggcattagtcaatgatacagtgggcacattggctggtgggagatatatggataccgatgtagttgcagctgtaatattgggcactggtacaaatgcagcatatgtggagcatgcaaatgcnnttcctaaatggactgggttactgcctaaatctggaaagat

SEQ ID NO: 1110 - DNA, 242 bp, Zea mays
tgttgatactgaaggtgaagatttccacctcccagagggtaggcagagagaacttggtttcacgttttccttcccagtgaaccaaacatcaatatcatcaggaacactcatcaagtggacaaagggtttttccatcaatggcacggttggtgaagatgttgtttctgagttgagcagggccatggagaggcagggactagatatgaaagttacggcattggtcaatgatacagttggcacat

SEQ ID NO: 1111 - DNA, 250 bp, Zea mays
ggaagggagaaacgtgttgtcaaacaacagtacgaggaggtttccattccaccgcatttgatggtcgggacttccattgaactatttgatttcattgctgctgcattggctaaatttgttgatactgaaggtgatgatttccacctcccagagggtaggcagagagaacttggtttcacgttttccttcccggtgaaccaaacatcaatatcatcaggaacactcatcatttggacaaagggcttttcca

SEQ ID NO: 1112 - DNA, 330 bp, Zea mays
cggaggaacaaactttagagtgctgaaagttgaagttggtgatgggtctgtggtcactcgccgtaaggtcgagcttcccatccctgaggaattgattaagggtacaattgaggagttattcaactttgttgccgtgaccctaaaggagttcgtagaagcagaagatggtaaagacgaacaaagggcacttggtttcacattttctttcccagtcagacaaacatcagtatcttcagggtccttaattaggtggaccaaagggtttttgattgaagatgtggttgggaaagatgtggctcaatgcttaaatgaagctcttgctaggagtgg

SEQ ID NO: 1113 - DNA, 289 bp, Zea mays
gaacgaagagggcgtcttctacgccttggaccttggcggaacgaacttccgcgtgctgcgcgtgcactcgccgggaaagacaggcgtgtggccaagcgagactccaaggaggtgtccatccctcctcacctcatgtcaggcaacgcgtcggagctgtttggcttcatcgcctcggcgctagctaagtacgtcgccgcggcgggcgaaggggacggcaggcagagagagctcgggttcaccttctctttccccgtgcgccagacgtcgatcgcgtcaggcacgctcatca

SEQ ID NO: 1114 - DNA, 295 bp, Zea mays
cgagagtccaaggaggtgtccatccctcctcacctcatgtcaggcaacgcatcggagctgtttggcttcatcgcctccgcgctagccaagtacgtcgccgcggcgggcgaaggggacggcaggcagagagagctcgggttcaccttctctttccccgtgcgccagacgtcgatcgcgtcaggcacgctcatcaagtggaccaaggcgttttcggtcgacgacgctgttggtgaggatgtcgtcgccgagctgcagacggccatggagaagcaaggcgtcgacatgcgtgtggcgg

SEQ ID NO: 1115 - DNA, 277 bp, Zea mays
cggctcgagggcaacgcatcggagctgtttggcttcatcgcctcggcgctagcaagtacgtcgccgcggcgggcgaaggggacggcaggcagagagagctcgggttcaccttctctttccccgtgcgccagacgtcgatcgcgtcaggcacgctcatcaagtggaccaaggcgttttcggtcgacgatgctgttggtgaggatgtcgtcgccgagctgcagacggccatggagaagcaaggcgtcgacatgcgtgtggcggcactgatcaacgatac

SEQ ID NO: 1116 - DNA, 275 bp, Zea mays
aggcgtgtggccaagcgagactccaaggaggtgtccatccctcctcacctcatgtcaggcaacgcgtcggagctgtttggcttcatcgcctcggcgctaccaagtacgtcgccgcggcgggcgaacgggacggcaggcagagagagctcgggttcaccttctctttccccgtgcgccagacgtcgatcgcgtcaggcacgctcatcaagtggaccaaggcgttttcggtcgacgacgctgttggtgaggatgtcgtcgccgagctgcagacggcc

SEQ ID NO: 1117 - DNA, 261 bp, Zea mays
ttctcatctcatctccccatcactgaatgatcaagaattagataaggagagcttaaatccaggagaacagatttacgagaagttaacgtcaggaatgtatttaggtgaaattgtaaggagggtgctccttaaaatatcattgcagtccgccatttttggtgatattgaccacactaagcttcaaacccatttccttctgcggactccacatatttcagcaatgcaccatgacgaaacatctgatctgaagattgtggccga

SEQ ID NO: 1118 - DNA, 267 bp, Zea mays
cccacgcgtccgcccattccatgttgatgaccatgtctcctgaatggggcagctcaccctcccattttggaatatgatcaagaattagataaggagagcttaaatccaggagaacagatttacgagaagttaacgtcaggaatgtatttaggtgaaattgtaaggagggtgctccttaaaatatcattgcagtccgccatttttggtgatattgaccacactaagcttcaaacccatttccttctgcggactccacatatttcagca

SEQ ID NO: 1119 - DNA, 296 bp, Zea mays
tgtcaagtggacaaaggcattttccattaatgatgctgtaggcgaagatgtggtggctgaactgcaaacagccatggagaagcaaggtctggacatgcatgtagctgcattgattaatgatgctgttgggacgctggcgggagcaaggtactacgacaaagatgttgtcgctggtgtaatatttggcactggcacaaacgcagcatatgttgagaaggcaaatgctattccaaaatgggagggtgagctgccccattcaggagacatggtcatcaacatggaatggggtaacttct

SEQ ID NO: 1120 - DNA, 307 bp, Zea mays
caaagatgttgtcgctggtgtaatatttggcactggcacaaacgcagcatatgttgagaaggcaaatgctattccaaaatgggagggtgagctgccccattcaggagacatggtcatcaacatggaatggggtaacttcttctcatctcatctccccatcactgaatatgatcaagaattagataaggagagcttaaatccaggagaacagatttacgagaagttaacgtcaggaatgtatttaggtgaaattgtaaggagggtgctccttaaaatatcgatgcagtccgccatttttggtgatatt

SEQ ID NO: 1121 - DNA, 197 bp, Zea mays
agatgttgtcgctggtgtaatatttggcactggcacaaacgcagcatatgttgagaaggcaaatgctattccaaaatgggagggtgagctgccccattcaggagacatggtcatcaacatggaatggggtaacttcttctcatctcatctccccatcactgaatatgatcaagaattagataaggagagcttaaatc

SEQ ID NO: 1122 - DNA, 170 bp, Zea mays
atttggagatgttgttccaactaagctggagcagccatttatattgaggacgccagatatgtcagccatgcatcatgactcttcgcatgacctcaaaactcttggatctaaactgaaggatatagttggggtcgcagatacttccctggaagtaagatacattactcgtc

SEQ ID NO: 1123 - DNA, 306 bp, Zea mays
ggcacattggctggtgggagatatgctgataatgatgttgttgctgctgtaatattgggcactggcacaaatgcagcttatgtggaacatgcaaatgtgattcctaaatggaccgggctgctacctagatcagggaacatggtaatcaacatggagtggggaaacttcagatcagataaacttccaaggtcggagtatgataaatccttagacttcgaaagtttgaaccctggtgagcagatatatgaaaagatgatttctggaatgtatcttggagaaattgtccggacgatcctgctgaaactg

SEQ ID NO: 1124 - DNA, 308 bp, Zea mays
ggcacattggctggtgggagatatgctgataatgatgttgttgctgctgtaatattgggcactggcacaaatgcagcttatgtggaacatgcaaatgtgattcctaaatggaccgggctgctacctagatcagggaacatggtaatcaacatggagtggggaaacttcagatcagataaacttccaaggtcggagtatgataaatccttagacttcgaaagtttgaaccctggtgagcagatatatgaaaagatgatttctggaatgtatcttggagaaattgtccggaggatcctgctgaaactggc

SEQ ID NO: 1125 - DNA, 315 bp, Zea mays
cccacgcgtccgattggctggtgggagatatgctgataatgatgttgttgctgctgtaatattgggcactggcacaaatgcagcttatgtggaacatgcaaatgtgattcctaaatggaccgggctgctacctagatcagggaacatggtaatcaacatggagtggggaaacttcagatcagataaacttccaaggtcggagtatgataaatccttagacttcgaaagtttgaaccctggtgagcagatatatgacaagatgatttctggaatgtatcttggagaaattgtccggacgatcctgctgaaactggc

SEQ ID NO: 1126 - DNA, 442 bp, Zea mays
gcagtttctggtcatcacatttgccaagaactccttatgacatctcccttgatgatgagacacaaaaccgcaatgatcaggtgaacaccctgtgcaaatcatgttatgtaatagttgtaccttttgttagtattgccgaacaaatttgacattgatgcaggggtttgagaaaatggtctctgggatttatcttggggaaattgcaaggctggtgctgcatcgaatggctctagaatcagatttttttggtgacgctgctgataatctatgtacccccttcacattgagcacaccactcctcgctgcaattcgcaaggacgattcaccagatctgagcgaagtcaggaagatactgcaagaacatctgaaggtcagctttcctgaccttcatgaagtcaaacatgtgttttcctccaacctgtgaaggttctggtgattttgc

SEQ ID NO: 1127 - DNA, 436 bp, Zea mays
ctgaaaactcgaaggctggttgtcaaagtgtgcgacatcgtcacccggagagctgcccggctagccgccgctggtattgtcgggatactgaaaaagctcggccgtgatgggagcggtgttgcttcaagcgggagaacgggagggcagatgaggcggacggtggttgccatcgagggtgggctgtacgagggctacccggtgttcagggagtacctagacgaagccctggtggagatcttgggggaggaggtggcgcggacggtggcgctgagggtgacagtggatgggtctggggccggcgctgccctccttgccgccgtacattcgtcgaatagacagcaaggttccatatagggagaagggaagatggtgatacagccccctctgtgcaaatgtaaaaaggaacattatttgatatctatattcatatatatat

SEQ ID NO: 1128 - DNA, 443 bp, Zea mays
caaacaacagtatgaggaggtttccattccaccacatttgatggtcgggacttccatgggactatttgatttcattgctgctgcattggctaaatttgtcggtactgaaggtgaagatttccaactcccagagggtagacagagagaacttggtttcactttttccttcccggtgaaccaaacatcaatatcatcaggaacactcatcaagtggacaaagggcttttccatcaatggcacggttggtgaagatgttgattctgagttgagcagggccatggagaggcaggggctagatatgaaagttacggcattagtcaatgatacagtcggcacattggctggtgggagatatatggataccgatgtagttgcagctgtaatattgggcactggtacaaatgcagcatatgtggagcatgcatatgcaattcctaaatggg

SEQ ID NO: 1129 - DNA, 419 bp, Zea mays
  unsure (1)..(419): unsure at all n locations
ggcgaggatgacgagctcctttctgaactaaaagataagtgggatgcaatggagaacaggtcctctcttgccttgtatggtgctggagcaatcctcgctgtctggatatccttggttgtagtgagatctctcgactctgtcccgttgctcccaggcatattggagctagtcgggctcagctactctggatggtttgtgtaccgatacctgctttttcaggaaaaccggaaagaattggccggtgttatcgatgatataaagagaaggattgttggcgatgatgaatagctgtttcctggtttgtaattctatttatctcgccctgtttggttctgaggaattgaaaaataatccaatggtgaagtgagaaagcactntctagttattggttntaattcatggngtccaaacaggctcct

SEQ ID NO: 1130 - DNA, 430 bp, Zea mays
cggaggaacaaactttagagtgttaagagttgaagttggtgctgggtctgtggtcacccgtcggaaggttgaacttcccatccctgaggaattgaccaagggtacaattgaggagctattcaactttgttgccatgactctaaaggaatttgtagaaacagaagatgggaacgatgaacaacgagcgcttggtttcacattttctttcccagttagacaaacatcagtatcttcggggtcattgattaggtggaataaagggtttttgattgaagatgcggttgggaaagatgtggctcaatgcttaaatgaagctcttgctaggaatggactaaatgtgcgagttactgcactggtgaatgacaccgtggggacattagctctaggacattatcacgatgaggatacagtggctgctgtgatcattggt

SEQ ID NO: 1131 - DNA, 356 bp, Zea mays
ggacctcaaagcgaagtgggacgccgttgaggacaagcccaccgtcctcttgtacggcggcggcgccgtcgtcgccctctggctgacgtccgtggtcgtgggcgccatcaacgccgtgccgctgctccccaagatcctggagctcgttgggctcggctacaccggctggttcgtgtaccgctaccttctcttcaaggaaagcaggaaagagttggccgccgacattgagaccttgaagaaaaaaatagctggaacagaataaacgctcatggaaagttttagagcgtcctttcttctttggaaagagatctattcgatcggagaaccaatgcaactacttgagtactattattgcc

SEQ ID NO: 1132 - DNA, 440 bp, Zea mays
cgccgctccgcgctccgccctcctccctcggcgcagcgtctgccagcttcgcttccaaggggcaccgaggctctccctgctccgtgcgaaggccgcttccgaggacacatcggcctccggcgacgagttgatcgaggacctcaaagcgaagtgggacgccgttgaggacaagcccaccgtcctcttgtacggcggcggcgccgtcgtcgccctatggctgacgtccgtggtcgtgggcgccatcaacgccgtgccgctgctccccaagatcctggagctcgttgggctcggctacaccggctggttcgtgtaccgctaccttctctttaaggaaagcaggaaagagttggccgccgacattgagaccttgaagaaaaaaatagctggaacagaataaacgctcatggaaagttttagagcgtcctttcttctttggaaag

SEQ ID NO: 1133 - DNA, 421 bp, Zea mays
aatccgtggcgctcctcggcggcgcgcgccttcccgccgctccgcgctccgccctcctccctcggcgcagcgtctgccagcttcgcttccaagatgcaccgaggctctccctgctccgtgcgaaggccgcttccgaggacacatcggcctccggcgacgagttgatcgaggacctcaaagcgaagtgggacgccgttgaggacaagcccaccgtcctcttgtacggcggcggcgccgtcgtcgccctttggctgacgtccgtggtcgtgggcgccatcaacgccgtgccgctgctccccaagatcctggagctcgttgggctcggctacaccggctggttcgtgtaccgctaccttctcttcaaggaaagcaggaaagagttggccgccgacattgagaccttgaagaaaaaaatagctgg

SEQ ID NO: 1134 - DNA, 420 bp, Zea mays
ggttctgtagcttccggtacgcttgttaagtggacaaaggcattttccattaatgatgctgtaggcgaagatgtggtggctgaactgcaaacagccatggagaagcaaggtctggacatgcatgtagctgcattgattaatgatgctgttgggacgctggcgggagcaaggtactacgacaaagatgttgtcgctggtgtaatatttggcactggcacaaacgcagcatatgttgagaaggcaaatgctattgcaaaatgggagggtgagctgccccattcaggagacatggtcatcaacatggaatggggtaacttcttctcatctcatcttcccatcactgaatatgatcaagaattagataaggagagcttaaatccaggagaacagatttacgagaagttaacgtcaggaatgtat

SEQ ID NO: 1135 - DNA, 420 bp, Zea mays
agggccatggaaaggcagggtcttgatatgaaagttgcagctctggttaatgacactgtaggcacattggctggtgggagatatgctgataatgatgttgttgctgctgtaatattgggcactggcacaaatgcagcttatgtggaacatgcaaatgcgattcctaaatggaccgggctgctacctagatcagggaacatggtaatcaacatggagtggggaaacttcagatcagataaacttccaaggtcggagtatgataaatccttagacttcgaaagtttgaaccctggtgagcagatatatgaaaagatgatttctggaatgtatcttggagaaattgtccggaggatcctgctgaaactggctcatgatgcttcattgtttggggatgttgttcctccgaaactggaacagcta

SEQ ID NO: 1136 - DNA, 107 bp, Zea mays
cggacactgggcgagacgcgtgggtgaagtttcggcgagatgttgatagacttcgtgcccaccgtggcgggggtctcgctagcggaagtgccggccttactcaaggc

SEQ ID NO: 1137 - DNA, 230 bp, Zea mays
gcgcccacctcctctgctctctcctctcccccacctctgcgtccgtgcgttgtgtttgtttaggcggcaaccgcgatgcgcaatggcggccgggcgagagctggtggtgagtttcggcgagatgttgatagacttcgtgcccaccgtggcgggggtctcgctggcggaggcgccgggcttcctcaaggcgcccggtggcgcgcccgctaacgtcgccatcgtggtctcgc

SEQ ID NO: 1138 - DNA, 240 bp, Zea mays
cgacgtcgtcataactggcgcctctatgagtcggcggactgctgccgctgcggcgtccaacaacctggtggtgtcgttcggcgagatgctgatcgacttcgtccccgacgtggccgtgctgtcgctggccgagtcgggcggcttcgtcaaggcacccggcggcgcgcccgccaacgtcgcctgcgccatcgccaagctcggcggatcctccgccttcgtaggcaagttcggcgacgacga

SEQ ID NO: 1139 - DNA, 300 bp, Zea mays
cggaccgtggcgtcaacgtcgccaaggacgactccatcttccacaacgaggagggagccgacgaaggcgtcgccggcgccggtggtgtcgacggtgtcgaccttgaagccgggcacgctgcccttgaagtccttggtgaagtacctgcatcccttgtccccgtcggtgacgacgagcagcttgagcccgtcaaaccacagggacagcacgttctcacgcgcgaggtcgtgcccggcatgatcgtcaccgggatggaggtcgcagagatcgacggcgccccgaggatgggcccgacgttcg

SEQ ID NO: 1140 - DNA, 183 bp, Zea mays
catgtactaccgcaaccccagcgctgacatgctcctcaccgccgacgagctcaacgtcgagctcatcaagaggagtgcggtcttccactacggatcaataagcttgattgctgagccttgccggacagcacatctccgtgccatggagattgccaaagaggcaggtgcacagctctcttatga

SEQ ID NO: 1141 - DNA, 339 bp, Zea mays
cttcaaagtacaacaagttgatacaactggcgcaggtgacgcgttcgttggtgctctgctccaaaggatcgttaaagatccatcctcgctacaagatgagaagaagcttgtggagtcgattaaattcgctaacgcgtgcggagcgtccaccaccacgaagaagggggcgatcccgtcgctgcccaccgaagcggaggtcttgcagctaatagagaaggcttagatcatcatcgtcctgtacgccatggttttcaccagcttctacttcttcgaattgtattggattctgatatggaacagaagaagaagcggctgccccatcttaccagccctttttgt

SEQ ID NO: 1142 - DNA, 310 bp, Zea mays
gcgacgacgagttcggccgcatgctcgccgccatcctccgcgacaacggcgtcgacgacggcggcgtcgtcttcgactccggcgcgcgcaccggctcgccttcgtcaccctgcgcgccgacggggagcgcgagttcatgttctaccgcaaccccagcgctgacatgctcgtcaccgccgacgagctcaacgtcgagctcatcaagagggctgcggtcttccagtacggatcagtaagcttgattgctgagccttgccggacagcacatctccgtgccatggagattgccaaacaggcaggtgcactgctc

SEQ ID NO: 1143 - DNA, 226 bp, Zea mays
cgacgagttcggccgcatgctcgtcgctatcctccgcgacaacggcgtcgacgacggcggcgtcgtcttcgactccggcgcgcgcaccgcgctcgccttcgtcaccctgcgcgccgacggggagcgcgagttcatgttctaccgcaatcccagcgctgacatgctcctcaccgccgacgagctcaacgtcgagctcatcaagagggctgcggtcttccactacgga

SEQ ID NO: 1144 - DNA, 260 bp, Zea mays
atccatcctcgctacaagacgagaagaagcttgtagagtctattaaattcgctaatgcgtgtggagcaatcaccgccacgaagaagggtgcgatcccgtctttgcccactgaaactgaggtcttgcagctaatagagaaggcatagatagatcactgtaattgctttggttttcactagcttccacttctgcaaattgcaaaatgtattgtattctgatctggaacagaagaagtgggtgctccatcttacctgccattt

SEQ ID NO: 1145 - DNA, 328 bp, Zea mays
cccacgcgtccgcaataagcttgattgctgagccttgccggacagcacatctccgtgccatggagattgccaaagaggcaggtgcactgctctcttatgacccaaacctgagggaggcactatggccatcccgtgaggaggcccgcacccagatcttgagcatctgggaccaggcagacattgtcaaggtcagcgaagtcgagctcgagttcttgacaggcatcgactcggtggaggacgatgttgtcatgaagctgtggcggcctaccatgaagctgctcctagtgactcttggagatcaagggtgcaagtactatgccagggattt

SEQ ID NO: 1146 - DNA, 314 bp, Zea mays
cttgattgctgagccttgccggacagcacatctccgtgccatggaaattgccaaagaggctggtgcactgctctcttacgacccaaacctgagggaggcactttggccatcccgtgaggaggcccgcacccagatcttgagcatctgggaccaggcagatatcgtcaaggtcagcgaagtcgagcttgagttcttgacaggcatcaactcagtggaggacgatgttgtcatgaagctgtggcgacctaccatgaagctgctcctggtgactcttggagatcaaggatgcaagtactataccagggatttccatg

SEQ ID NO: 1147 - DNA, 286 bp, Zea mays
ccggacagcacatctccgtgccatggagattgccaaagaggcaggtgcactgctctcttatgacccaaacctgagggaggcactatggccatcccgtgaagaggcccgcacccagatcttgagcatctgggaccaggcagacattgtcaaggtcagcgaagtcgagctcgagttcttgacaggcatcgactcggtggaggacgatgttgtcatgaagctgtggcggcctaccatgaagctgctcctagtgactcttggagatcaagggtgcaagtactatgccagg

SEQ ID NO: 1148 - DNA, 272 bp, Zea mays
cggacgcgtggtggagattgccaaagaggcaggtgcactgctctcttatgacccaaacctgaggacggcactatggccatcccgtgaggaggcccgcacccagatcttgagcatctgggaccaggcagacattgtcaaggtcagcgaagtcgagctcgagttcttgacaggcatcgactcggtggaggacgatgttgtcatgaagctgtggcggcctaccatgaagctgctcctagtgactcttggagatcaagggtgcaagtactatgcca

SEQ ID NO: 1149 - DNA, 286 bp, Zea mays
agctcaacgtcgagctcatcaagagggctgcggtcttccactacggatcaataagcttgattgctgagccttgccggacagcacatctccgtgccatggagattgccaaagaggcaggtgcactgctctcttatgacccaaacctgagggaggcactatggccatcccgtgaggaggcccgcacccagatcttgagcatctgggaccaggcagacattgtcaaggtcagcgaagtcgagctcgagttcttgacaggcatcgactcggtggaggacgatgttgtcat

SEQ ID NO: 1150 - DNA, 263 bp, Zea mays
gcggtctttcactacggatcaataagcttgattgctgagccttgccggacagcacatctccgtgccatggaaattgccaaagaggctggtgcactgctctcttacgacccaaacctgagggaggcactttggccatcccggaggaggcccgcacccagatcttgagcatctgggaccaggcagatatcgtcaaggtcagcgaagtcgagcttgagttcttgacaggcatcaactcagtggaggacgatgttgtcatgaagctg

SEQ ID NO: 1151 - DNA, 297 bp, Zea mays
aggtggaggacgatgttgtcatgaagctgtggcggcctaccatgaagctgctcctagtgactcttggagatcaagggtgcaagtactatgccagggatttccatggcgctgtgccttccttcaaagtacaacaagttgatacaactggcgcaggtgacgcgttcgttggtgctctgctccaaaggatcgttaaagatccatcctcgctacaagatgagaagaagcttgtggagtcgattaaattcgctaacgcgtgcggagcgatcaccaccacgaagaagggggcgatctcgtcgc

SEQ ID NO: 1152 - DNA, 293 bp, Zea mays
caggcatcgactcggtggaggacgatgttgtcatgaagctgtggcggcctaccatgaagctgctcctagcgactcttgtagatcaagggtgcaagtactatgccagggatttccatggcgctgtgccttccttcaaagtacaacaagttgatacaactggcgcaggtgacgcgttcgttggtgctctgctccaaaggatcgttaaagatccatcctcgctacaagatgagaagaagcttgtggagtcgattaaattcgctaacgcgtgcggagcgatcaccaccacgaagaag

SEQ ID NO: 1153 - DNA, 286 bp, Zea mays
atcgactcggtggaggacgatgttgtcatgaagctgtggcggcctaccatgaagctgctcctagtgactcttggagatcaagggtgcaagtactatgccagggatttccatggcgctgtgccttccttcaaagtacaacaagttgatcaactggcgcaggtgacgcgttcgttggtgctctgctccaaaggatcgttaaagatccatcctcgctacaagatgagaagaagcttgtggagtcgattaaattcgctaacgcgtgcggagcgatcaccaccacgaagaa

SEQ ID NO: 1154 - DNA, 276 bp, Zea mays
gagaagaagcttgtggagtcgatggatctttaacgatcctttggagcagagcaccaacgaacgcgtcacctgcgccagttgtatcaacttgttgtactttgaaggaaggcacagcgccatggaaatccctggcatagtacttgcacccttgatctccaagagtcactaggagcagcttcatggtagaccgtaacagcttcatgacaacatcgtcctccaccgagtcgatgcctgtcaagaactcgagctcgacttcgctgaccttgacaatgtctg

SEQ ID NO: 1155 - DNA, 276 bp, Zea mays
  unsure (1)..(276): unsure at all n locations
agctcaacgtcgagctcatcaagagggctgcggtcttccactacggatcaataagcttgattgctgagccttgccggacagcacatctccgtgccatggagattgccanagaggcaggtgcactgctctcttatgacccaaacctgagggaggcactatggcaatcccgtgaggaggcccgcaccagatcttgagcatctgggacaggcagacattgtcaaggtcaacgagtcgagctcgagtcttgacaggatcgactcggtggaggcgatgttg

SEQ ID NO: 1156 - DNA, 230 bp, Zea mays
agcacatctccgtgccatggagattgccaaagaggcaggtgcactgctctcttatgacccaaacctgagggaggcactatggccatcccgtgaggaggcccgcacccagatcttgagcatctgggaccaggcagacattgtcaaggtcagcgaagtcgagctcgagttcttgacaggcatcgactcggtggagtacgattttgtcatgaagctggggcggcctaccatga

SEQ ID NO: 1157 - DNA, 294 bp, Zea mays
gtcgcctgcgccatcgccaagctcggcggatcctccgccttcgtaggcaagttcggcgacgacgagttcgggcacatgctggtgaacatcctgaagcagaacaacgtgaactcggaggggtgcctgttcgacaagcacgcgcggacggcgctggccttcgtgacgctcaagcacgacggggagcgcgagttcatgttctacaggaacccgagcgcggacatgctgctgacggaggcggatctggacctgggcctggtgcggcgcgccagggtgttccactacggctccatctcg

SEQ ID NO: 1158 - DNA, 299 bp, Zea mays
gcctgttcgacaagcacgcgcggacggcgctggccttcgtgacgctcaagcacgacggggagcgcgagttcatgttctacaggaacccgagcgcggacatgctgctgacggaggcggagctggacctgggcctggtgcggcgcgccagggtgttccactacggctccatctcgctcatctccgagccgtgccgctcggcgcacatggccgccatgcgcgcagccaaggcggcgggcgtgctctgctcctacgaccccaacgtgcgcctcgcgctctggccgtcagccgacagcgcacgc

SEQ ID NO: 1159 - DNA, 255 bp, Zea mays
aggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggctctcaagttctccaacgcctgcggcgccatctgcaccaccaagaagggcgccatcccggcgctgcccacggtcgccaccgcccaggacctcatcgccaag

SEQ ID NO: 1160 - DNA, 326 bp, Zea mays
ccgcacgcgagggcatcctcagcatctggaaggaggccgacttcatcaaggtcagcgacgacgaggtggccttcctcacgcgcggggacgccaacgacgagaagaacgtgctgtccctgtggtttgacgggctcaagctgctcgtcgtcaccgacggggacaagggatgcaggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggcc

SEQ ID NO: 1161 - DNA, 297 bp, Zea mays
cggcgctggccttcgtgacgctcaagcacgacggggagcgcgagttcatgttctacaggaacccgagcgcggacatgctgctgacggaggcggagctggacctgggcctggtgcggcgcgccagggtgttccactacggctccatctcgctcatctccgagccgtgccgctcggcgcacatagccgccatgcgcgcagccaaggccgcgggcgtgctctgctcctacgaccccaacgtgcgcctcgcgctctggccgtcgcccgacgccgcacgcgagggcatcctcagcatctgga

SEQ ID NO: 1162 - DNA, 235 bp, Zea mays
caagctgctcgtcgtcaccgacggggacaagggatgcaggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggctctcaagttctccaacgcctgcgtggccatctgcaccaccaag

SEQ ID NO: 1163 - DNA, 347 bp, Zea mays
  unsure (1)..(347): unsure at all n locations
tcctacgacnccaacgtgcgcctcccgctctggccgtcgcccgacgccgcacgcgagggcatcctcagcatctggaaggaggccgactacatcaaggtcagcgacgacgaggtggccttcctcacgcgcggggacgccaacgacgagaagaacgtgctgtccctgtggtttgacgggctcaagctgctcgtcgtcaccgacggggacaagggatgcaggtacttcaccaaggacttcaagggcagcgtgcccggcttcaaggtcgacaccgtcgacaccaccggcgccggcgacgccttcgtcggctcactcctcgtcaacgtcgccaaggacgactccatcttcca

SEQ ID NO: 1164 - DNA, 262 bp, Zea mays
  unsure (1)..(262): unsure at all n locations
gatgctcgtcgtcaccgacggggacaagggatgcaggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggctctcaagttctccaacgcctgcgaggncatctgcaccaccaagaagggcgccatcccggcgctgcccacggtc

SEQ ID NO: 1165 - DNA, 291 bp, Zea mays
  unsure (1)..(291): unsure at all n locations
gaacgtgctgnccctgnggtttgacgggctcaagctgctcgtcgtcaccgacggggacaaaggatgcaggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctcnggatgntctcaagttctccaacgcctgcggcgccatctgcaccaccaagaagggcgccatcncggcgctgcccang

SEQ ID NO: 1166 - DNA, 371 bp, Zea mays
cggcggactggacctgggcctggtgcggcgcgccaggtgttccactacggctccatctcgctcatctccgagccgtgccgctcggcgcacatggccgccatgcgcgcaccaaggccgcgggcgtgctctgctcctacgaccccaacgtgcgcctcccgctctggccgtcgcccgacgccgcacgcgagggcatcctcagcatctggaaggaggccgacttcatcaaggtcagcgacgacgaggtggccttcctcacgcgcggggacgccaacgacgagaagaacgtgctgtccctgtggtttgacgggctcaagctgctcgtcgtcaccgacggggacaagggatgcaggtagcttcaccaagacttcaag

SEQ ID NO: 1167 - DNA, 310 bp, Zea mays
  unsure (1)..(310): unsure at all n locations
gtcgtccccgacgtggccgggctgtcgctggccgagtcgggcggcttcgtcaaggcacccggcggcgcgcccgccaacgtcgcctgcgccatcgccaagctcggcggatcctccgccttcgtaggcaagttcggcgacgacgagttcgggcacatgctggtgaacatcctgaagcagaacaacgtgaacgcggacgggtgcctgttcgacaagcacgcgcggacggcgctggggttcgtgacgctcaagcagtacggggagcgcgagttcatgttctacangaacccgagcgacgacatgctgctgacgg

SEQ ID NO: 1168 - DNA, 280 bp, Zea mays
cccacgcgtccgtcgacaagcacgcgcggacggcgctggccttcgtgacgctcaagcacgacggggagcgcgagttcatgttctacaggaacccgagcgcggacatgctgctgacggaggcggagctggacctgggcctggtgcggcgcgccagggtgttccactacggctccatctcgctcatctccgagccgtgccgctcggcgcacatggccgccatgcgcgcagcaaggccgcgggcgtgctctgctcctacgaccccaacgtgcgcctcgcgctc

SEQ ID NO: 1169 - DNA, 311 bp, Zea mays
cccacgcgtccgcccacgcgtccggatgcaggtacttcaccaaggacttcaagggcagcgtgcccggcttcaaggtcgacaccgtcgacaccaacggcgccggcgacgccttcgtcggctccctcctcgtcaacgtcgccaaggacgactccatcttccacaacgaggagaagctccgcgaggctctcaagttctccaacgcctgcagcgccatctgcaccaccaagaagggcgccatcccggcgctgcccacggtcgccaccgcccaggacctcatcgccaaggccaactagatggccgcacaccccgcc

SEQ ID NO: 1170 - DNA, 266 bp, Zea mays
cgaggtggccttcctcacgcgcggggacgccaacgacgagaagaacgtgctgtccctgtggtttgacgggctcaagctgctcgtcgtcaccgacggggacaagggatgcaggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggccc

SEQ ID NO: 1171 - DNA, 272 bp, Zea mays
acttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggctctcaagttctccaacgcctgcagcgccatctgcaccaccaagaagggcgccatcccggcgctgcccacggtcgctaccgcccaggacctcatcgccaaggccaactagatggccgcacgc

SEQ ID NO: 1172 - DNA, 275 bp, Zea mays
aaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggccctcaagttctccaacgcctgcgggccatctgcaccaccaagaagggcgccatcccggcgctgcccacggtcgccaccgcccaggacctcatcgccaaggccaactagatggccgcacgccccgccgttcca

SEQ ID NO: 1173 - DNA, 300 bp, Zea mays
gaagaacgtgctgtccctgtggtttgacgggctcaagctgctcgtcgtcaccgacggggacaagggatgcaggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggccctcaagttctccaacgcctgcgtggccatctgcaccaccaagaagggcgccatcccggcgctgcccacggtcgc

SEQ ID NO: 1174 - DNA, 277 bp, Zea mays
cgctcaagcacgacggggagcgcgagttcatgttctacaggaacccgagcgcggacatgctgctgacggaggcggagctggacctgggcctggtgcggcgcgccagggtgttccactacggctccatctcgctcatctccgagccgtgccgctcggcgcacatggccgccatgcgcgcagcaaggccgcgggcgtgctctgctcctacgaccccaacgtgcgcctcccgctctggccgtcgcccgacgccgcacgcgagggcatcctcagcatctgg

SEQ ID NO: 1175 - DNA, 279 bp, Zea mays
gagcagcgtgcccggcttcaaggtcgacaccgtcgacaccaccggcgccggcgacgccttcgtcggctccctcctcgtcaacgtcgccaaggacgactccatcttccacaacgaggagaagctccgcgaggctctcaagttctccaacgcctgcgaggccatctgcaccaccaagaagggcgacacaccggcgctgcccacggtcgccaccgcccaggacctcatcgccaaggccaactagatggccgcacgccccgccgttccaccacgtcactgtcc

SEQ ID NO: 1176 - DNA, 292 bp, Zea mays
gcgagggcatcctcagcatctggaaggaggccgacttcatcaaggtcagctacgacgaggtggccttcctcacgcgcggggacgccaacgacgagaagaacgtgctgtccctgtggtttgacgggctcaagctgctcgtcgtcaccgacggggacaagggatgcaggtacttcaccaaggacttcaagggcagcgtgcccggcttcaaggtcgacaccgtcgacaccaccggcgccggcgacgccttcgtcggctccctcctcgtcaacgtcggcaaggacgactccatctt

SEQ ID NO: 1177 - DNA, 288 bp, Zea mays
aaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggccctcaagttctccaacgcctgcgggccatctgcaccaccaagaagggcgccatcccggcgctgcccacggtcgccaccgcccaggacctcatcgccaaggccaactagatggccgcacgccccgccgttccaccacgtcactgtc

SEQ ID NO: 1178 - DNA, 272 bp, Zea mays
cccacgcgtccgacgagttcgggcacatgctggtgaacatcctgaagcagaacaacgtgaacgcggaggggtgcctgttcgacaagcacgcgcggacggcgctggccttcgtgacgctcaagcacgacggggagcgcgagttcatgttctacaggaacccgagcgcggacatgctgctgacggaggcggagctggacctgggcctggtgcggcgcgccagggtgttccactacggctccatctcgctcatctccgagccgtgccgctcggcg

SEQ ID NO: 1179 - DNA, 225 bp, Zea mays
gtgaactcggaggggtgcctgttcgacaagcacgcgcggacggcgctggccttcgtgacgctcaagcacgacggggagcgcgagttcatgttctacaggaacccgagcgcggacatgctgctgacgaaggcgaacctgaacttgggcttgttccgcgcgccaaggtgttccactacggctccatctcggtcatcttcgagccgtgccgctcggcgaaaatggccg

SEQ ID NO: 1180 - DNA, 243 bp, Zea mays
gccgacttcatcaaggtcagcgacgacgaggtggccttcctcacgcgcggggacgccaacgacgagaagaacgtgctgtccctgtggtttgacgggctcaagctgctcgtcgtcaccgacggggacaagggatgcaggtacttcaccaaggacttcaagggcagcgtgcccggcttcaaggtcgacaccgtcgacaccacgggcgccggcgacgccttcgtcggctccctcctcgtcaaggtc

SEQ ID NO: 1181 - DNA, 286 bp, Zea mays
gtgctctgctcctacgaccgcaacgtgcgcctcccgctctggccgtcgcccgacgccgtacgcgagggcatcctcagcatctggaaggaggccgacttcatcaaggtcagcgacgacgaggtggccttcctcacgcgcggcgacgccaacgacgagaagaacgtgctgtccctgtggtttgacgggctcaagctgctcgtcgtcaccgacggggacaagggatgcaggtacttcaccaaggacttcaagggcagcgtggcccgcttcaaggtcgacaccgtcgaca

SEQ ID NO: 1182 - DNA, 265 bp, Zea mays
cgctcatctccgagccgtgccgctcggcgcacatggccgccatgcgcgcaccaaggcggcgggcgtgctctgctcctacgaccccaacgtgcgcctcccgctctggccgtcgcccgacgccgcacgcgagggcatcctcagcatctggaaggaggccgacttcatcaaggtcagcgacgacgaggtggccttcctcacgcgcggggacgccaacgacgagaagaacgtgctgtccctgtggtttgacgggctcaagctgctcgtc

SEQ ID NO: 1183 - DNA, 276 bp, Zea mays
cccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggccctcaagttctccaacgcctgcgggccatctgcaccaccaagaagggcgccatcccggcgctgcccacggtcgccaccgcccaggacctcatcgccaaggccaactagatggccgcacgccccgccgttc

SEQ ID NO: 1184 - DNA, 336 bp, Zea mays
gaacgtgctgtccctgtggtttgacgggctcaagctgctcgtcgtcacgcggggacaagggatgcaggtacttcaccaaggacttcaagggcagcgtgcccggcttcaaggtcgacaccgtcgacaccaccggcgccggcgacgccttcgtcggctcccctcctcgtcaacgtcgccaaggacgactccatcttccacaacgaggagaagctccgcgaggctctcaagttctccaacgcctgcgtggccatctgcaccaccaagaagggcgccatcccggcgctgcccacggtcgcctacgcccaggacctcatcgccaaggccaactagatggcc

SEQ ID NO: 1185 - DNA, 329 bp, Zea mays
gcgcggacatgctgctgacggaggcggactggacctgggcctggtgcggcgcgccacggtgttccactacggctccatctcgctcatctccgagccgtgccgctcggcgcacatggccgccatgcgcgcaccaaggccgcgggcgtgctctgctcctacgacttcatcaaggtcagcgacgacgaggtggccttcctcacgcgcggggacgccaacgacgagaagaacgtgctgtccctgtggtttgacggctcaagctgctcgtcgtcaccgacggggacaagggatgcaggtacttcaccaaggacttcaagggcagcgtgcccggc

SEQ ID NO: 1186 - DNA, 237 bp, Zea mays
gccccatgcgcgcaccaaggccgcgggcgtgctctgctcctacgaccccaacgtgcgcctcccgctctggccgtcgcccgacgccgcacgcgagggcatcctcagcatctggaatgaggccgacttcatcaaggtcagcgacgacgaggtggccttcctcacgcgcggggacgccaacgacgagaagaacgtgctgtccctgtggtttgacgggctcaagctgctcgtcgtcaccga

SEQ ID NO: 1187 - DNA, 196 bp, Zea mays
cccacgcgtccgcccacgcgtccgcgacttcatcaaggtcagcgacgacgaggtggccttcctcacgcgcggggacgccaacgacgagaagaacgtgctgtccctgtggtttgacgggctcaagctgctcgtcgtcaccgacggggacaagggatgcaggtacttcaccaaggacttcaagggcagcgtgcccggc

SEQ ID NO: 1188 - DNA, 283 bp, Zea mays
cgtcaacgtcgccaaggacgactccatcttccacaacgaggagaagctccgcgaggctctcaagttctccaacgcctgcggcgccatctgcaccaccaagaagggcgccatcccggcgctgcccacggtcgccaccgcccaggacctcatcgccaaggccaactagatggccgcacgccccgccgttccaccacgtcactgtcccccgccgccccgcccctcgtcgtcgacgtcctcggtttcggttcattaggtagatcgagtcttagcgtccgtctctgcg

SEQ ID NO: 1189 - DNA, 171 bp, Zea mays
gaacaacgtatacgcggaggggtgcctgttcgacaagcacgcgcggacgggctggccttcgtgacgctcaagcacgacggggagcgcgagttcatgttctacaggaacccgagcgcggacatgctgctgacggaggcggactggtacctgggcctggtgcggcgcgccagg

SEQ ID NO: 1190 - DNA, 267 bp, Zea mays
ggacgactccatcttccacaacgaggagaagctccgcgaggccctcaagttctccaacgcctgcggcgccatctgcaccaccaagaagggcgccatcccggcgctgcccacggtcgccaccgcccaggacctcatcgccaaggccaactagatggccgcatgccccgccgttccaccacgtcactgtcccccgccgccccgcccctcgtcgtcgacgtcctcggtttcggttcattaggtagatcgagtcttagcgtccgtctctgc

SEQ ID NO: 1191 - DNA, 201 bp, Zea mays
ccgacttcatcaaggtcagcgacgacgaggtggccttcctcacgcgcggggacgccaacgacgagaagaacgtgctgtccctgtggtttgaagggctcaagctgctcgtcgtcaccgacggggacaagggatgcaggtacttcaccaaggacttcaagggcagcgtgcccggcttcaaggtcgacaccgtcgacaccaccg

SEQ ID NO: 1192 - DNA, 272 bp, Zea mays
caacggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggccctcaagttctccaacgcctgcggcgccatctgcaccaccaggaagggcgccatcccggcgctgctgcaggtcgccaccgcccaggacctcatcgccaaggccaactagatggccgcacgcaccgccgttccaccac

SEQ ID NO: 1193 - DNA, 307 bp, Zea mays
ctgcggaggctctcaagttctccaacgcctgcaggccatctgcaccaccaagaagggcgccatcccggcgctgcccacggtcgccaccgcccaggacctcatcgccaaggccaactagatggccgcacgcccgccgttccaccacgtcactgtccccctcgtcgtcgacgtcctcggtttcggttcattaggtagatcgagtcttagcgtccgtctctgcgcctctacgctgagacggtttgtttgggttaattaagttagctttcgtggagatttcgccccggggcatcaaataaaatgttggcat

SEQ ID NO: 1194 - DNA, 306 bp, Zea mays
ggcggactgctgccgcggcggcgtccaacaacctggtggtgtcgttcggcgagatgctgatcgacttcgtccccgacgtggccgggctgtcgctggccgagtcgggctgcttcgtcaaggcacccggcggcgcgcccgccaacgtcgcctgcgccatcgccaagctcggcggatcctccgccttcgtaggcaagttctgcgacgacgagttcgggcacatgctggtgaacatcctgaagcagaacaacgtgaacgcggaggggtgcctgttcgacaagcacgcgtggacggcgctggccttcgtga

SEQ ID NO: 1195 - DNA, 314 bp, Zea mays
cgcctcgctttcccttccccaccagcccgtctctctcttctctctgactctctctctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcgtcaaggcacccggcggcgcgcccgccaacgtcgcctgcgccatcgtcaagctcggcggatcctccgccttcgtaggcaagtt

SEQ ID NO: 1196 - DNA, 308 bp, Zea mays
cacctcgccttcccttccccaccagcccccgtctctctctctctctctctgtctctctctcgtagccgcgtccatctcgcagcagcaagcaagcgcgaccaaatggcgcctctaggagacggcggactgctgccgcggcggcgtccaacaacctggtggtgtcgttcggcgagatgctgatcgacttcgtccccgacgtggccgggctgtcgctggccgagtcgggcggcttcgtcaaggcacccggcggcgcgcccgccaacgtcgcctgcgccatcgccaagctcggcggaatctccgccttcgta

SEQ ID NO: 1197 - DNA, 279 bp, Zea mays
cgtctctctctctctctctctgtctctctctcgtagccgcgtccatctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcgtcaaggcacccggcggcgcgcccgccaacgtcgcctgcgccatcgccaagctcggcggatcctccgccttcgt

SEQ ID NO: 1198 - DNA, 331 bp, Zea mays
cccacgcgtccgcgcctcgccttcccttccccaccagcccccgtctctctctctctctctctgtctctctctcgtagccgcgtccatctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcgtcaaggcacccggcggcgcgcccgccaacgtcgcctgcgccatcgtcaagctcggcggatcctccgccttcgtaggcaagttcg

SEQ ID NO: 1199 - DNA, 299 bp, Zea mays
gcctcgccttcccttccccaccagcccccgtctctctctctctctctctgtctctctctcgtagccgcgtccatctcgcagcagcaagcaagcgcgaccaaatggcgcctctaggagacggcggagtgctgccgcggcggcgtccaacaacctggtggtgtcgttcggcgagatgctgatcgacttcgtccccgacgtggccgggctgtcgctggccgagtcgggcggcttcgtcaaggcacccggcggcgcgctcgccaacgtcgcctgcgccatcgccaagctcggcggatcctccg

SEQ ID NO: 1200 - DNA, 276 bp, Zea mays
cgtctctctctctcttctctctgactctctctctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcgtcaaggcccccggcggcgcgcacgccaacgtcgcctgcgccatcgccaagctcggcggctcctccgc

SEQ ID NO: 1201 - DNA, 278 bp, Zea mays
cccacgcgtccgcccacgcgtccgcctcgccttcccttccccaccagcccccgtctctctctctctctctctgtctctctctcgtagccgcgtccatctcgcagcagcaagcaagcgcgaccaaatggcgcctctaggagacggcggactgctgccgcggcggcgtccaacaacctggtggtgtcgttcggcgagatgctgatcgacttcgtccccgacgtggccgggctgtcgctggccgagtcgggcggcttcgtcaaggcacccggcggcgcgcc

SEQ ID NO: 1202 - DNA, 190 bp, Zea mays
  unsure (1)..(190): unsure at all n locations
gtagccgcgtccacctcgcagcagcaagcaagcgcgaccaaatgggcgcctctaggagacggcggantgctgccgcggcggcgtccaacaacctggtggtgtcgttcggcgagatgctgatcgacttcgtccccgacgtggccgggctgtcgctggccgagtcgggcggcttcgtcaaggcacccggcgg

SEQ ID NO: 1203 - DNA, 275 bp, Zea mays
agcacaatcgcctcgccttcccttccccaccagcccccgtctctctctctcttctctctgactctctctctcgtagccgcgtccacctcgcagcagcatgcaagcgcgaccaaatggcgcctctaggagacggcggagctgctgccgcggcggcgtccaacaacctggtggtgtcgttcggcgatatgctgatcgacttcgtccccgacgtggccgggctgtcgctggccgagatcggcggcttcgtcaaggcccccggtggcgcgctcgccaac

SEQ ID NO: 1204 - DNA, 316 bp, Zea mays
gtctctctcttctctctgactctctctctcgtagccgcgtccacctcgcagcagcaagcaagcgcgaccagatggcgcctctaggagacggcggagtgctgccgcggcggcgtccaacaacctggtggtgtcgttcggcgagatgctgatcgacttcgtccccgacgtggccgggctgtcgctggccgagtcgggcggcttcgtcaaggcattcggcggcgcgcccgccaacgtcgcctgcgacatcgccaagctcggcggatcctccgccttcgtaggcaagttcggcgacgacgagttcgggcacatgctggtg

SEQ ID NO: 1205 - DNA, 247 bp, Zea mays
ctctctctctcgtagccgcgtccacctcgcagcagcaagcaagcgcgactaaatggcgtctctaggagacggtggactgctgctgcggcggcgtccaacaatctggtggtgtcgttcggcgagatgctgatcgacttcgtccccgacgtggctgggctgtcgctggccgattcgggcggcttcgtcaaggcaccctgcggcgcgctcgctaatgtcgccttcgccatcgccaagctcggcggatcct

SEQ ID NO: 1206 - DNA, 418 bp, Zea mays
cgacgagctcaacgtcgagctcatcaagagggctgcggtcttccactacggatcagggagcttgattgctgagccttgccggacagcacatctccgtgccatggagattgccaaagaggcaggtgcactgctctcttatgacccaaacctgagggaggcactatggccatcccgtgaggaggcccgcacccagatcttgaacatctgggaccaggcagacattgtcaaggtcagcgaagtcgagctcgagttcttgacaagcatcgactcggtggaggacgatgttgtcatgaagctgtggcggcctaccatgaagctgctcctagtgactcttggagatcaagggtgcaagtactatgccagggatttccatggcgctgtgccttccttcaaagtacaacaagttgatacaactggc

SEQ ID NO: 1207 - DNA, 295 bp, Zea mays
cgacgagctcaacgtcgagctcatcaagagggctgcggtcttccactacggatcaataagcttgattgctgagccttgccggacagcacatctccgtgccatggagattgccaaagaggcaggtgcactgctctcttatgacccaaacctgagggaggcactatggccatcccgtgaggaggcccgcacccagatcttgagcatctgggaccaggcagacattgtcaaggtcagcgaagtcgagctcgagttcttgacaggcatcgactcggtggaagacgatgttgtcatgaag

SEQ ID NO: 1208 - DNA, 439 bp, Zea mays
actcggaggggtgcctgttcgacaagcacgcgcggacggcgctggccttcgtgacgctcaagcacgacggggagcgcgagttcatgttctacaggaacccgagcgcggacatgctgctgacggaggcggagctggacctgggcctggtgcggcgcgccagggtgttccactacggctccatctcgctcatctccgagccgtgccgctcggcgcacatggccgccatgcgcgcagccaaggccgcgggcgtgctctgctcctacgaccccaacgtgcgcctcccgctctggccgtcgcccgacgccgcacgcgagggcatcctcagcatctggaaggaggccgacttcatcaaggtcagcgacgacgaggtggccttcctcacgcgcggtgacgccaacgacgagaagaacgtgctgtccctgtggtttgacgggctcaa

SEQ ID NO: 1209 - DNA, 383 bp, Zea mays
aatcgacaagcacgcgcggacggcgctggccttcgtgacgctcaagcacgacggggagcgcgagttcatgttctacaggaacccgagcgcggacatgctgctgacggaggcggagctggacctgggcctggtgcggcgcgccagggtgttccactacggctccatctcgctcatctccgagccgtgccgctcggcgcacatggccgccatgcgcgcagccaaggcggcgggcgtgctctgctcctacgaccccaacgtgcgcctcccgctctggccgtcgcccgacgccgcacgcgagggcatcctcagcatctggaaggaggccgacttcatcaaggtcagcgacgacgaggtggccttcctcacgcgcggggacgccaacg

SEQ ID NO: 1210 - DNA, 451 bp, Zea mays
  unsure (1)..(451): unsure at all n locations
cgacgagttcgggcacatgttggtgaacatcctgaagcagaacattgtgaactcggaggggtgcctgttcgacaagcacgcgcggacggcgctggccttcgtgacgctcaagcacgacggggagcgcgagttcatgttctacaggaacccgagcgcggacatgctgctgacggaggcggagctggacctgggcctggtgcggcgcgccaaggtgttccactacggctccatctcgctcatctccgagccgtgccgctcggcgcacatggccgccatgcgcgcagccaaggccgcgggcgtgctctgctcctacgaccccaacgtgcgccttccgctctggccgtcgcccgacgccgcacgcgagggcatcctcagcatctggaaggaggccgacttcatcaaggtcagcgacgacgaggtggccttcctcacgcgcggngacgccaacgac

SEQ ID NO: 1211 - DNA, 497 bp, Zea mays
  unsure (1)..(497): unsure at all n locations
gagagttctcnnnttaagtagcttactgtcttggtagtactcgtaccggatcggagtttccgaccaaaccgtccggtccgacaggacgcctcgaccggggttggctttcttgccgttaagccccaacggggacggcaagttaatgtattacaggaacccaaccgcggacatgctgtttacggaggcggagctggacctgggcctggtccggtgcgccagggtgttccactacgggtccatctcgctcatctccgatccgtgccggtcggcgcacatggccgacatgcgcgcagccaatgccgcgggcgtgctctggtcctacgacctcaacgtgcgccttccgctctggccgtcgcccgacgccgtacgcgagggcatcctcagcatctggaacgaggccgacttcatcaaggtcagcgacgacgatgtggccttactcacgcgcggggacgccaacgacgagaagaacgtgctgtccctgtggtttgacgggctca

SEQ ID NO: 1212 - DNA, 253 bp, Zea mays
ctccatcttccacaacgaggagaagctccgcgaggctctcaagttctccaacgcctgcggcgccatgtgcaccaccaagaagggcgccatcccggcgctgcccacggtcgccaccgcccaggacctcatcgccaaggccaactagatggccgcacgccccgccgttccaccacgtcactgtcccccgccgccccgcccctcgtcgtcgacgtcctcggtttcggttcattaggtagatcgagtcttaccgtcc

SEQ ID NO: 1213 - DNA, 375 bp, Zea mays
cggactcgtgggcggactcgtgggcggactcgtgggcggactcgtgggcggactcgtgggggcgtgctctgctcctacgaccccaacgtgcgcctcccgctctggccgtcgcccgacgccgcacgcgagggcatcctcagcatctggaaggaggccgacttcatcaaggtcagcgacgacgaggtggccttcctcacgcgcggggactccaacgacgagaagaacgtgctgtccctgtggtttgacgggctcaagctgctcgtcgtcaccgacggggacaagggatgcaggtacttcaccaaggacttcaagggcagcgtgcccggcttcaaggtcgacaccgtcgacaccaccggcgccggcgacgccttcgtc

SEQ ID NO: 1214 - DNA, 411 bp, Zea mays
  unsure (1)..(411): unsure at all n locations
cccacgcgtccgaacgaggagaagctccgcgaggctctcaagttctccaacgcctgcggcgccatctgcaccaccaagaagggcgccatcccggcgctgcccacggtcgccaccgnccaggacctcatcgccaaggccaactagatggccgcacgcccgccgttccaccacgtcactgtccccctcgtcgtcgacgtcctcggtttcggttcattaggtagatcgagtcttagcgtccgtctctgcgcctctacgctgagacggtttgtttgggttaattaagttagctttcgtggagatttcgccccggggcatcaaataaaatgttggcatgcgtggtgggatgctatcctttatttttattttattttattttttagcttggatcagttggggttttgaacattgcta

SEQ ID NO: 1215 - DNA, 403 bp, Zea mays
tcgaccccttttgctgaacatgcttaagcctatcaataagtactcggaggggtgcctgtacgacaggcgcgctttgacggcgctgggggtcctgactctcaagcacgacggggagcgcgagttcatgttctacaggaacccgagcgcggacatgctgctgacggaggcggagctggacctgggcctggtgcggcgcgccaaggtgttccactacggctccatctcgctcatctccgagccgtgccgctcggcgcacatggccgccatgcgcgcagccaaagccgtgggcgtgctctgcttctacgaccccaacgtgcgccttccgctctggccgtcgaccgacgccgcacgcgagggcatactcagcatctggaaagaggccgacttcatcaaggtcagcgac

SEQ ID NO: 1216 - DNA, 315 bp, Zea mays
agctgcgagaggtgtgaaggacgtcgtgctatgactggccgcatgattcattcggggccaccaggcctatgggaggcagcccccggtaccattcgtggggactacgccgtggaggtcggcaggaatgtcatccatggaagcgactccgtggagaacgggatgaaggagacgctctctggttcctgaaggtgtgcacaagcgagagcaccttcatccctgatctacgaggctgagcattgagctggatgcatgctgctcatggaaccagagtttgtgagtatatctgttgctctgctagatcatattacgcctggg

SEQ ID NO: 1217 - DNA, 268 bp, Zea mays
ctttttctgaatacctcacagatccaaaaatgtcttccgaacagagtttcattgccatcaagcccgatggtgtccagcgtggcctcgttggacccatcatctctcgcttcgagtcccgtggcttcaagctcgccgctttgaagttggtctctccgcctcgtgagctcctcgagaagcaatatgccgacctctccgagaagcctttcttccccggtctcgttacatacatgttgagcggccccatcgttgccatggtctgggagggccg

SEQ ID NO: 1218 - DNA, 284 bp, Zea mays
  unsure (1)..(284): unsure at all n locations
cccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcacagcactacgctgacctttccgacaagactttcttccccgngttggtggagtacatc

SEQ ID NO: 1219 - DNA, 296 bp, Zea mays
  unsure (1)..(296): unsure at all n locations
tcgccncctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcacagcactacgctgacctttccgacaagcctttcttccccgggttggtggagtacatcaattccggccccgtggtgg

SEQ ID NO: 1220 - DNA, 302 bp, Zea mays
tgtccatcgcgcctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcacagcactacgctgacctttccgacaagcctttcttccccgggttggtggagtacatcatttccggccccgtggtggc

SEQ ID NO: 1221 - DNA, 372 bp, Zea mays
cgtccatcgcgcctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcacagcactacgctgacctttccgacaagcctttcttccccgggttggtggagtacatcatttccggccccgtggtggcgatggtgtgggaggggaaggacgtcgtgttgactggccgcagatcattggggccacaggcttgggaggca

SEQ ID NO: 1222 - DNA, 299 bp, Zea mays
ctcctctcataacccaccagtccatcgcaccctccctccggtcagcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagagcactacgctgacctttccgacaagcctttcttctccgggttggtggagtaca

SEQ ID NO: 1223 - DNA, 327 bp, Zea mays
cggacgcgtggcgctcccacagcctcacccctgcgcccccgccgattcgcgtcgccctttgttggaaagaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcacagcactacgctgacctttccgacaagcctttcttccccgggttggtggagtacatcatttccggccccgtggtggcgatggtgtgtgaggggaagacgtcgtgtgactggcccaga

SEQ ID NO: 1224 - DNA, 284 bp, Zea mays
cccccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagagcactacgctgacctttccgacaagcctttcttccccgggttggtgg

SEQ ID NO: 1225 - DNA, 256 bp, Zea mays
cccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcacagcactacgctgacctttccgacaagcctttcttccccg

SEQ ID NO: 1226 - DNA, 276 bp, Zea mays
gagcagaccttcatcatgatcaagcccgacggcgtccagcggggcctgatcggggacatcatcagtcgcttcgagaagaaagggttctacctcaaggggatgaagttcatgaacgtggagaggtccttcgcgcacagcactacgctgacctttccgacaagcctttcttccccgggttggcgatatacatcatttccggccccgtggtggcgatggtgtgggaggggaaggacgtcgtgttgactggccgcaggatcattggggccaccaggcctt

SEQ ID NO: 1227 - DNA, 357 bp, Zea mays
ggaaggaacgatggagcagaccttcatcatgatcaagcccgacggcgtccagcgggcctgatcggggacatcatcagtcgcttcgagaagaaagggttctacctcaaggggatgaagttcatgaacgtggagaggtccttcgcgcagaaagatacgctgacctttccgacaagcctttcttccccgggttggtggagtacatcatttccggccccgtggtggcgatggtgtgggagggaaggacgtcgtgttgactggccgcaggatcattggggccacaaggcttgggaggcagccccggtaccattcgtggggactagccgtggaagtcggcaggaatgtcatccaggaagcgac

SEQ ID NO: 1228 - DNA, 279 bp, Zea mays
atgcctcccccacccgtccatcgcccctccctccggtctgctctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctactccaaggggatgaagttcatgaacgtggagaggtccttcgcgcacagcactacgctgacctttccgacaagctttcttccccgg

SEQ ID NO: 1229 - DNA, 301 bp, Zea mays
ttttcgtcacccctgacgctcgacgcctctcctcctctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcacagcactacgctgacctttccgacaag

SEQ ID NO: 1230 - DNA, 266 bp, Zea mays
tcctctccccccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagagcactacgctgacctttccgac

SEQ ID NO: 1231 - DNA, 267 bp, Zea mays
cggggcctgatcggggacatcatcagtcgcttcgagaagaaagggttctacctcaaggtgatgaagttcatgaacgtggagaggtccttcgcgcacagcactacgctgacctttccgacaagcctttcttccccgggttggtggagtacatcatttccggccccgtggtggcgatggtgtgggaggggaaggacgtcgtgttgactggccgcaggatcattgggccaccaggccttgggaggcagccccggtaccattcgtggggat

SEQ ID NO: 1232 - DNA, 332 bp, Zea mays
gtccagcggggcctgatcggggacatcatcagtcgcttcgagaagaaagggttctacctcaaggggatgaagttcatgaacgtggagaggtccttcgcgcacagcactacgctgacctttccgacaagcctttcttcgccgggttggtggagtacatcatttccgagcccgtggtggcgatggtgtgggaggggaagacgtcgtgtgactgccgcagatcattggggccacagcccttaggagcagccccggtaccatcgtgggactagccgtgaagtcgcagaatgcatcatgaagcgatcgtgagacgggagaagagtcgtctctgtcct

SEQ ID NO: 1233 - DNA, 183 bp, Zea mays
cgcaagaacgatggagcagaccttgatcatgatcaagcacgacggcgtccagcggggcctgatcggggacatcatcagtcgcttcgagaagaaagggttctacctcaaggggatgaagttcatgaacgtggagaggtccttcgcgcacagctactacgctgacctgtccgacaagcctttctt

SEQ ID NO: 1234 - DNA, 282 bp, Zea mays
tgcgacccggcgattcgcgtcgctctttgctggaaggaacgatggagcagaccttcatcatgatcaagcccgtcggcgtccagcggggcctgatcggggacatcatcagtcgcttcgagaagaaagggttctacctcaacgggatgaagttcatgaacgtggagaggtccttcgcgcacagcactacgctgacctttccgacaagcctttcttccccgggttggtggagtacatcatttacggcaccgtggtggcgatggtgtcggaggcgaaggacgtcgt

SEQ ID NO: 1235 - DNA, 283 bp, Zea mays
ctcgacgcctctcctcctctcctatcccacacgttcatcgccccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagagccactacgctgacctttccgaca

SEQ ID NO: 1236 - DNA, 260 bp, Zea mays
cgcctctcctcctctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagagcactac

SEQ ID NO: 1237 - DNA, 260 bp, Zea mays
cgcctctcctcctctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcacagcactac

SEQ ID NO: 1238 - DNA, 269 bp, Zea mays
cgacgcctctcctcctctccccccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcacagcactacgctgac

SEQ ID NO: 1239 - DNA, 289 bp, Zea mays
acggcgtccagcggggcctgatcggggacatcatcagtcgcttcgagaagaaagggttctacctcaaggggatgaagttcatgaacgtggagaggtccttcgcgcacagcactacgctgacctttccgacaagcctttcttccccgggttggtggagtacatcatttccggccccgtggtggcgatggtgtgggaggggaaggacgtcgtgttgactggccgcagatcattggggcaccagccttgggaggcaccccggtacattctggggatacgccgtgaatcgcag

SEQ ID NO: 1240 - DNA, 263 bp, Zea mays
ccctgacgctcgacgcctctcctcctctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgc

SEQ ID NO: 1241 - DNA, 264 bp, Zea mays
ccctgacgctcgacgcctctcctcctctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgca

SEQ ID NO: 1242 - DNA, 257 bp, Zea mays
ctctcctcctctccttacacaaccgtccatcgacgctccctccggtctgcgctcccacagcctcacccctgcggtgccgatgattcgcgtcgccctttgttggaatgacgatggagcagaccttcatcatgatcaagcccgacggcgtccagcggggcctgatcggggacatcatcagtcgcttcgagaagaaagggttctacctcaaggggatgaagttcatgaacgtgcagaggtccttctcgcgaagaattagg

SEQ ID NO: 1243 - DNA, 313 bp, Zea mays
  unsure (1)..(313): unsure at all n locations
ggaaggaacgatggagcagaccttcatcatgatcaagcacgacggcgtccagcgnggcctgatcngggacatcatcagtcgcttcgagaagaaggggtctacctcaaggggatgaagttcatgaacgtggagaggtcttcgcgcagagcactacgctgacctttccgacaagccttntcttcccggggttggtggagtacatcatttccggccccgtggtggcgatggtgtgggaggggaaggacgtcgtgttgactggccgcagatcattggggccaccagcttgggaggcaccccggtacattcgtgggat

SEQ ID NO: 1244 - DNA, 270 bp, Zea mays
gtggagaacgggaagaaggagatcgctctctggttccctgaaggtgtggcacagtggaagagcaaccttcatccctggatctacgaggcttgagcagttgagcttggatgccttgcctgctccatggaaaccagagttttgtttgagtattatctgttggctctggctgaagagtcataatttagcgctctgtgtgttacaccagagttaagtctgcctgaacttatgtggcatttgtttgagtttctgccttcgtgccctgttttctaa

SEQ ID NO: 1245 - DNA, 275 bp, Zea mays
tagaggagatcgctctctggttccctgaaggtgtggcacagtggaagagcaaccttcatccctggatctacgaggcttgaacagttgagcttggatgacttgcctgcttccatggaaaccagagttttgtttgagtattatctgttggctctggctgaagagtcataatttagcgctctgtgtgttacaccagagttaagtctgcctgaacttatgtggcatttgtttgagtttctaccttcgtgccctgttttctaatgtaccgtggttgtgaa

SEQ ID NO: 1246 - DNA, 271 bp, Zea mays
actaattggtgccacagacgcacagagatctgaaccaggaaccatcaggggtgatcttgccattgttgttggaagagacatcattcatggaagtgatggcccagagacagcgaaggatgagatcgctttatggtttgaacccaaggactggtctcttacaccagcaatgcggagaagtggatcaatttaaaagaattaacgagagagtcaatctgttttttttccttcttttgatctcggttttcacataattgccgacagacctaggcac

SEQ ID NO: 1247 - DNA, 404 bp, Zea mays
  unsure (1)..(404): unsure at all n locations
aacggacgcgtgggtgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaggaaagggttctaccgcaaggggatgaagtgcatgaacgtgtagaggtccttcgcgcaggagcactacgcgggggggggcggcaacgcgtgggttggcnngtgtggtngagcgggtgattgccggccccgtgggggctggggtgtgggaggggaaggacgtcgtgttgactggccgcaggatcattggggccaccaggccttgggaggcagcccccggtaccattcgtggggactacgccgtggaag

SEQ ID NO: 1248 - DNA, 347 bp, Zea mays
tcgcccactcgttcgtccactctttcgcgtccatcgccccctccctccggtctgcgctcccagagcctctcccctgcgcccccgccgattcgcgtctccctttgttggaaggaacgatggagcagaccttcatcatgatcaagcccgacggcgtccagcggcgcctgatcggggacatcatcagtcgcttcgagaagaaagggttctacctcaaggggatgaagttcatgaacgtggaaaggtccttcgctcatcagcactacgctgacctttccgacaagcctttcttccccgggttggtggagtacatcatttccggccccgtggtggcgattgtgtgggaaggg

SEQ ID NO: 1249 - DNA, 340 bp, Zea mays
gcggagcagaccttcatcatgatcaagcccggcggcgtccagcggggcctgatcggggacatcagcagtcgcttcgagaggagggggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcaagaatgtca

SEQ ID NO: 1250 - DNA, 464 bp, Zea mays
cggacgcgtgggctcccccacccgtccatcgccccctccctccggtctgcgctcccacaggctcgcccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaagggtaagtgcgtttcattttgttctcgaattgattgctggaacacgtactctgtttaaatttcctagctatacgcatgaacttctctgctgttgaggcaagatttgatgtgcagattctggtgatatcttagaattgtttaatctatgtatacgttcggttgcgtgtgatcaccatctgaaaaaggatgttggtcgtggaagcaggaatattgcgtggagattagatttgattgaaaaccattatcttgatgtca

SEQ ID NO: 1251 - DNA, 504 bp, Zea mays
  unsure (1)..(504): unsure at all n locations
cgcgggggtgngaaacgatcattcggcgagcncggtccgaactatccggggcccagcacgcgtccggagctgtgctctgctctgctctcgcctcgcacggactcgtggtaaaggatggagaccatgtcggctctcgcgaggacggcgccgccccttgctgggaccattcgccggccctcatgcgcgctgaggccgacggcgtccctctccttcgccgccgcttcaacgacgccccgcggccggctcgggctggggctgagcacggcgccggcggggagcgggagggcggccagggctcgcgccgtcccgcggcgcatcgtcgcctcctcggaggttgagcaaagctacattatgatcaaaccagatggtgttcagcgtggtctggttggagagattatttctcgctttgagaagaaagggtttttgttgaaaggcttaaaacttttccagtgccccaaggacttggcgcaggagcattacaaggatttgaagggataaactttc

SEQ ID NO: 1252 - DNA, 233 bp, Zea mays
gtttttgcagttagtagaatatgttagtggctcctatgatagggtggaaggatttgagttattgaatgaggcaatctctgagtatgagacttcagaaaacaatgactcgggaagctaccgcagattattttatttggcattgcctccatcagtctacccatcagtatgcgagatgataagatcatattgcatgagtccatcttcacacaccggttggacaagggttattgttg

SEQ ID NO: 1253 - DNA, 180 bp, Zea mays
tcgttcggcagcagcaacgaggtgctggatgggacgccgacgggagatggggcaccggggcaggggcagcggggagcgagcaccgtcagcatcacggtcgtcggcgcctccggcgacctcgccaagaagaagatcttcccggccctcttcgccttgttctacgagggctggctcccggag

SEQ ID NO: 1254 - DNA, 137 bp, Zea mays
cacagatcttgatagggccactaatgagcttgtgatacgtgtgcaaccggatgaagcaatttacctaaagattaacaacaagattcctggtctcggtatgcgactagataggagtaacttgaatctccattatgccg

SEQ ID NO: 1255 - DNA, 272 bp, Zea mays
ggaggacaaacttttcggttgggtgctggacgactgcggggattgctcagttgccgagggatgccttatggacacaaacaatgatcccatcgatgttgatgcacacatgtacaggtatcatctacatgttttacaatatatattttttaggagttacttttaaaaaatattagaaaaccccttctttgatattttcaatttttttggtggcttaaaaaaacaagaaagtaaattttacaaaccttagagatggtctaagtcgtccatgcata

SEQ ID NO: 1256 - DNA, 264 bp, Zea mays
cccacgcgtccgctgatttcaggttcatatttgatgcaatgcatgcaattactggtgcgtatgccggacccatttttgttgagaaacttggagctgatccggactgcatattaaatggggtgcctcttgaagattttggaaatggccatccagatccaaatctaacttacgctaaggagcttgtttttactatgtttggagcccatgcacctgactttggtgcaacaagtgatggtgatggtgatcggaacatgattcttggga

SEQ ID NO: 1257 - DNA, 299 bp, Zea mays
gtcatttacctgttgatggagccataatgataacagcaagccatctcccctacaatcggaatggtctcaagttttttacaagtgatggtgggctaaataaagctgatatcaaagatatcctggagcgtgcttccaaaatatatgaggaatctgcacataataacctgaaagaacagggggaagcttcgaagggagttgtcactaatgtggactacatgtcaatttatgcttctgatcttgtacaagcagttcgtaaatctgctggagacaaagaaaaaccattggaggaactgcatata

SEQ ID NO: 1258 - DNA, 242 bp, Zea mays
atctgggctgtgtctggcgttgctttccatacttgcagaccggaacaaggataaggatgtcggagagggattagtgtcagttgaagatattgctatggagcactggaaaacctatggcaggaatttcttgtctagatacgattatgaggcgtgtgaatcacacagtgcaaaccagatgatggatcacgttagagatgttatggcaaatagcaagcctggagagaaatacggaaattacaccc

SEQ ID NO: 1259 - DNA, 224 bp, Zea mays
cggacgcgtggcgagacgcgtgggcttgtacaagcagttcgtaaatctgctggagacaaagaaaaaccattggaggaactgcatatagtcgttgatgcagggaatggtgctggtggtttttttgtggataaggtactcaaaccattaggagctgttaccactggaagtcaattccttgagcctgatggtttgtttcccaatcacattcccaaccctgaggacaa

SEQ ID NO: 1260 - DNA, 304 bp, Zea mays
gggagccttatcagggatctgcaggagcccgccgagtccgtgctcctccggatggacatcatgggtgagcccaaggatgccaaggaaagggccacacatgcagttgaggcttttaagaactacatccaggaggacaaacttttcggttgggtgctggacgactgcggggattgctcagttgccgagggatgccttatggacacaaacaatgatcccatcgatgttgatgcacacatgtacagagcaaaactatacgacgagaatcagagagcagtaggcatggtccacattcgtcaaagcgtgc

SEQ ID NO: 1261 - DNA, 347 bp, Zea mays
  unsure (1)..(347): unsure at all n locations
tgtgtgacttcagatggattgactgtatttattgaaaatanacttggagggaagcatcaccgtttcaaacgagggtacaagaatgtaatagacgaggctattcgtctgaactctattggtgaggagtcacatttggccatgganacaagtgggcatggagcgctgaaagagaaccactggcttgatgatggagcataccttatggtcanacttttgaataaacttgctgctgctagaacactgggttcaagtattggtagtaaagttttgactgatttggttgagggccttgaagaagctgatgtgacagttgaaataaggttaaagattgatcagaatcatgcaga

SEQ ID NO: 1262 - DNA, 287 bp, Zea mays
gaattttgaaaaggtgacggaaatagtgaggagcggagaacaccggaatgatccatcctctcgtgctatccctgccctcccccgctataatatcgcgccctcgtcgccatcgtcaccacaccaccactccctcactgccctctcactcccgatccctgcaccactaccgcctcctccgcgtcacccctctcgtcgcctcttgcggcgaccggcggcggatcgtccgctgcgctaggcaaccatggggctcttcaccgtgacgaagaaggctaccaccccttcgaagg

SEQ ID NO: 1263 - DNA, 338 bp, Zea mays
cacattcgtgagaaggatggcatctgggctgtgcttgcatggctttcaattcttgccttcaagaataaggacaaccttggaggagataagcttgtcactgttgaagatattgtccgtcagcactgggccacatatggtcgccattactacacacgctatgactatgagaatgttgatgcaggggctgctaaggagcttatggcaaacctagtaagcatgcagtcatcactttctgatgttaacaagttggtcaaggagatccggtctgatgtttctgaagtagttgcagctgacgagtttttgtacaaggatcctgttgatggctctgtgtccaagca

SEQ ID NO: 1264 - DNA, 341 bp, Zea mays
cacattcgtgagaaggatggcatctgggctgtgcttgcatggctttcaattattgctttcaagaataaggacaaccttggaggagataagcttgtcactgttgaagatattgtccgtcagcactgggccacatatggtcgccattactacacacgctatgactatgagaatgttgatgcagcttctgctaaggagcttatggcaaacctagtaagcatgcagtcatcactttctgatgttaacaagttggtcaaggagatccggtctgatgtttctgaagtagttgcagctgacgagtttgagtacaaggatcctgttgatggctctgtgtccaagcacca

SEQ ID NO: 1265 - DNA, 314 bp, Zea mays
cgaaagaggactttggaggtggtcatccggatcctaaccttacctatgcaaaagagttggttgaacgcatgggtcctggaaagtcatcctcaaatgttgagcctcctgaatttggcgctgcagctgatggagatgctgaccgcaacatgattcttggtaaaagattctttgtgacaccgtcggactctgttgccattatcgcagccaatgctgttcaatcaattccttactttgcttctggcctgaagggagttgccaggagcatgccaacatctgctgctcttgatgttgttgcaaagaatttgaaccttaag

SEQ ID NO: 1266 - DNA, 318 bp, Zea mays
ggtcatccggatcctaaccttacctatgcaaaagagttggttgaacgcatgggtcttggatagtcatcctcaaatgttgagcctcctgaatttggtgctgcagctgatggagatgctgaccgcaacatgattcttggtaaaagattctttgtgacaccgtcggactctgttgccattatcgcagccaatgctgttcaatcaattccttactttgcttctggcctgaagggagttgccaggagcatgccaacatctgctgcccttgatgttgttgcaaagaatttgaaccttaagttctttgaggtgcctactggatgg

SEQ ID NO: 1267 - DNA, 304 bp, Zea mays
gtcatccggatcctaacctcacctatgcaaaagagttggttgaacggatgggtcttggaaagtcatcctcaaatgttgaacctcctgaatttggtgctgcagctgatggagatgctgaccgcaacatgattctgggtaaaagattctttgtgacaccatcggactctgttgccattatagcggccaatgctgttcaatcaattccttactttgcttctggcctgaagggagttgccaggagcatgccaacatcagctgcccttgatgttgttgcaaagaatttgaatctcaagttctttgaggg

SEQ ID NO: 1268 - DNA, 298 bp, Zea mays
gagctgatggcaaacctagtaagcatgcagtcatcactttctgatgttaacaagttgatcaaggagatccggtctgatgtttctgaagtagttgcagctgacgagtttgagtacaaggatccagttgatggctctgtgtccaagcaccagggcatccgatacctcttcggagatggttcacgactggtgttccgtctatccggaaccggttctgttggtgccaccatccgtgtctacatcgagcaatacgagaaggattcctccaagaccggcagggattcacaggaggcccttgctc

SEQ ID NO: 1269 - DNA, 294 bp, Zea mays
gagataagcttgtcactgttgaagatattgtccgtcagcactgggccacatatggtcgccattactacacacgctatgactatgagaatgttgatgcaggggctgctaaggagcttatggcaaacctagtaagcatgcagtcatcactttctgatgttaacaagttggtcaaggagatccggtctgatgtttctgaagtagttgcagctgacgagtttgagtacaaggatcctgttgatggctctgtgtccaagcaccagggcatccgatacctctttggagatggttcacgac

SEQ ID NO: 1270 - DNA, 328 bp, Zea mays
cggctcgagggtcatccggatcctaacctcacctatgcaaaagagttggttgaacggatgggtcttggaaagtcatcctcaaatgttgaacctcctgaatttggtgctgcagctgatggagatgctgaccgcaacatgattctgggtaaaagattctttgtgacaccatcggactctgttgccattatagcggccaatgctgttcaatcaattccttactttgcttctggcctgaagggagttgccaggagcatgccaacatcagctgcccttgatgttgttgcaaagaatttgaatctcaagttctttgaggtgcctactgggtgga

SEQ ID NO: 1271 - DNA, 285 bp, Zea mays
ataagcttgtcactgttgaagatattgtccgtcagcattgggccacatatggtcgccattattacacacgctatgactatgagaatgtcgatgctggggctgctaaggagctgatggcaaacctagtaagcatgcagtcatcactttctgatgttaacaagttgatcaaggagatccggtctgatgtttctgaagtagttgcagctgacgagtttgagtacaaggatccagttgatggctctgtgtccaagcaccagggcatccgatacctcttcggagatggtt

SEQ ID NO: 1272 - DNA, 284 bp, Zea mays
gttgcaaagaatttgaatctcaagttctttgaggtgcctactgggtggaaattttttgggaatttgatggatgctggaatgtgctcaatctgtggtgaagaaagctttggcactgggtctgaccacattcgtgagaaagatggcatctgggctgtgcttgcatggctttctattattgctttcaagaataaggacaaccttggaggagataagcttgtcactgttgaagatattgtccgtcagcattgggccacatatggtcgccattattacacacgctatga

SEQ ID NO: 1273 - DNA, 277 bp, Zea mays
agtttacattctgttatgatgcactccatggtgttgcgggagcttatgccaaacacatctttgtggaagagcttggtgctgatgaaagctcactgttgaattgtgtcccgaaagaggactttggaggtggtcatccggatcctaaccttacctatgcaaaagagttggttgaacgcatgggtcttggaaagtcatcctcaaatgttgagcctcctgaatttggtgctgcagctgatggagatgctgaccgcaacatgaatcttggtaaaagattctt

SEQ ID NO: 1274 - DNA, 291 bp, Zea mays
cccacgcgtccgaatgtgctcaatctgtggtgaagaaagctttggcactgggtctgaccacattcgtgagaaggatggcatctgggctgtgcttgcatggctttcaattattgctttcaagaataaggacaaccttggaggagataagcttgtcactgtcgaagatattgtccgtcagcactgggccacatatggtcgccattactacacacgctatgactatgagaatgttgatgcaggggctgctaaggagcttatggcaaacctagtaagcatgcagtcatcactttc

SEQ ID NO: 1275 - DNA, 275 bp, Zea mays
cgatgctggggctgctaaggagctgatggcaaacctagtaagcatgcagtcatcactttctgatgttaacaagttgatcaaggagatccggtctgatgtttctgaagtagttgcagctgacgagtttgagtacaaggatccagttgatggctctgtgtccaagcaccagggcatccgatacctcttcggagatggttcacgactggtgttccgtctatccggaaccggttctgttggtgccaccatccgtgtctacatcgagcaatacgagaagg

SEQ ID NO: 1276 - DNA, 290 bp, Zea mays
ctcggactctgttgccattatagcggccaatgctgttcaatcagttccttactttgcttctggcctgaagggagttgccaggagcatgccaacatcagctgcccttgatgttgttgcgaagaatgtgaatctcaagttctttgaggtgcctactgggtggaaattttttgggaatttgatggatgctggaatgtgctcagtctgtggtgaagaaagctttggcactgggtctgaccacattcgtgagagagatggcatctgggctgtgcttgcatggctttctattattg

SEQ ID NO: 1277 - DNA, 275 bp, Zea mays
cttcgaagcaataaaaaagctactgacctccccaaagtttacattctgttatgatgcgctccatggtgttgctggagcttatgccaaacacatctttgtggaagagcttggtgctgatgaaagctcactgttgaattgtgtcccaaaagaggactttggaggtggtcatccggatcctaacctcacctatgcaaaagagttggttgaacggatgggtcttggaaagtcatcctcaaatgttgaacctcctgaatttggtgctgcagctgatggag

SEQ ID NO: 1278 - DNA, 286 bp, Zea mays
tctttggagatggttcacgactggtgttccgcctctctggaaccggttctgttggtgccaccatccgtgtctacatcgagcagtacgagagggactcctctaagaccggcagggattcacaggacgcccttgctccgctggttgatttgcgctcaagctctccaagatgcaagagtacactggacgctctgcccccaccgtcatcacataaattttgaagagtgttttagaatgagttgaggcgcttacacaaatttcattccggcctcttgttccatagtttttc

SEQ ID NO: 1279 - DNA, 305 bp, Zea mays
ctttgtgacaccgtcggactctgttgccattatcgcagccaatgctgttcaatcaattccttactttgcttctggactgaagggagttgccaggagcatgccaacatctgctgcccttgatgttgttgcaaagaatttgaaccttaagttctttgaggtgcctactggatggaagttttttgggaatttgatggatgctggaatgtgctcaatctgtggtgaagaaagctttggcactgggtctgaccacattcgtgagaaggatggcatctgggctgtgcttgcatggctttcaattattgctt

SEQ ID NO: 1280 - DNA, 271 bp, Zea mays
cggacgctgggtgcgtgctgcagctgatggagatgctgaccgcaacatgattcttggtaaaagattctttgtgacaccgtcggactctgttgccattatcgcagccaatgctgttcaatcaattccttactttgcttctggcctgaagggagttgccaggagcatgccaacatctgctgcccttgatgttgttgcaaagaatttgaaccttaagttctttgaggtgcctactggatggaagttttttgggaatttgatggatgctggaatg

SEQ ID NO: 1281 - DNA, 290 bp, Zea mays
ggacaaccttggaggagataagcttgtcactgttgaagatattgtccgtcagcattgggccacatatggtcgccattattacacacgctatgactatgagaatgtcgatgctggggctgctaaggagctgttggcaaccctagtaagcatgcagtcatcactttctgatgttaacaagttgatcaaggagatccggtctgatgtttctgaagtagttgcagctgacgagtttgagtacaaggatccagttgatggctctgtgtccaagcaccagggcatccgatacctct

SEQ ID NO: 1282 - DNA, 274 bp, Zea mays
cgtcggactctgttgccattatcgcagccaatgctgtggggatcaattccttactttgcttctggcctgaagggagttgccaggagcatgccaacatctgctgctcttgatgttgttgcaaagaatttgaaccttaagttctttgaggtgcctactggatggaagttttttgggaatttgatggatgctggaatgtgctcaatctgtggtgaagaaagctttggcactgggtctgaccacattcgtgagaaggatggcatctgggctgtgcttg

SEQ ID NO: 1283 - DNA, 253 bp, Zea mays
aagagcttggtgctgatgaaagctcactgttgaattgtgtcccaaaagaggactttggaggtggtcatccggatcctaacctcacctatgcaaaagagttggttgaacggatgggtcttggaaagtcatcctcaaatgttgaacctcctgaatttggtgctgcagctgatggagatgctgaccgcaacatgattctgggtaaaagattctttgtgacaccatcggactctgttgccattatagcggccaatgc

SEQ ID NO: 1284 - DNA, 253 bp, Zea mays
gagattctttgtgacaccgtcggactctgttgccattatcgcagccaatgctgttcaatcaattccttactttgcttctggcctgaagggagttgccaggagcatgccaacatctgctgctcttgatgttgttgcaaagaatttgaaccttaagttctttgaggtgcctactggatggaagttttttgggaatttgatggatgctggaatgtgctcaatctgtggtcgaagaaagctttggtactgggtctga

SEQ ID NO: 1285 - DNA, 249 bp, Zea mays
gcagtcatcactttctgatgttaacaagttggtcaaggagatccggtctgatgtttctgaagtagttgcagctgacgagtttgagtacaaggatcctgttgatggctctgtgtccaagcaccagggcatccgatacctctttggagatggttcacgactggtgttccgcctctctggaaccggttctgttggtgccaccatccgtgtctacatcgagcagtacgagagggactcctctaagaccggcag

SEQ ID NO: 1286 - DNA, 259 bp, Zea mays
cgactggtgttccccctctctggaaccggttctgttggtgccaccatccgtgtctacatcgagcagtacgagagggactcctctaagaccggcagggattcacaggacgcccttgctccgctggttgatgttgcgctcaagctctccaagatgcaagagtacactggacgctctgcccccaccgtcatcacataaattttgaagagtgttttagaatgagttgaggcgcttacacaaactttcattccggcctcttgtt

SEQ ID NO: 1287 - DNA, 248 bp, Zea mays
ctttgaggtgcctactggatggaagttttttgggaatttgatggatgctggaatgtgctcaatctgtggtgaagaaagctttggcactgggtctgaccacattcgtgagaaggatggcatctgggctgtgcttgcatggctttcaattattgctttcaagaataaggacaaccttggaggagataagcttgtcactgtcgaagatattgtccgtcagcactgggccacatatggtcgccattactaca

SEQ ID NO: 1288 - DNA, 235 bp, Zea mays
caaccttggaggagataagcttgtcactgttgaagatattgtccgtcagcactgggccacatatggtcgccattactacacacgctatgactatgagaatgttgatgcaggggctgctaaggagcttatggcaaacctagtaagcatgcagtcatcactttctgatgttaacaagttggtcaaggagatccggtctgatgtttctgaagtagttgcagctgacgagtttgagtac

SEQ ID NO: 1289 - DNA, 233 bp, Zea mays
caattccttactttgcttctggcctgaagggagttgccaggagcatgccaacatctgctgcccttgatgttgttgcaaagaatttgaaccttaagttctttgaggtgcctactggatggaagttttttgggaatttgatggatgctggaatgtgctcaatctgtggtgaagaaagctttggcactgggtctgaccacattcgtgagaaggatggcatctgggctgtgcttgca

SEQ ID NO: 1290 - DNA, 253 bp, Zea mays
ggaggagataagcttgtcactgtcgaagatattgtccgtcagcactgggccacatatggtcgccattactacacacgctatgactatgagaatgttgatgcaggggctgctaaggagcttatggcaaacctagtaagcatgcagtcatcactttctgatgttaacaagttggtcaaggagatccggtctgatgtttctgaagtagttgcagctgacgagtttgagtacaaggatcctgttgatggctctgtgt

SEQ ID NO: 1291 - DNA, 231 bp, Zea mays
gcacgagaaagctttggcactgggtctgaccacattcgtgagaaagatggcatctgggctgtgcttgcatggctttctattattgctttcaagaataaggacaaccttggaggagataagcttgtcactgttgaagatattgtccgtcagcattgggccacatatggtcgccattattacacacgctatgactatgagaatgtcgatgctggggctgctaaggagctgatg

SEQ ID NO: 1292 - DNA, 223 bp, Zea mays
gtcatcactttctgatgttaacaagttgatcaaggagatccggtctgatgtttctgaagtagttgcagctgacgagtttgagtacaaggatccagttgatggctctgtgtccaagcaccagggcatccgatacctcttcggagatggttcacgactggtgttccgtctatccggaaccggttctgttggtgccgacatccgtgtctacatcgagcaatacgag

SEQ ID NO: 1293 - DNA, 232 bp, Zea mays
cccacgcgtccggttgaagatattgtccgtcagcactgggccacatatggtcgccattactacacacgctatgactatgagaatgttgatgcaggggctgctaaggagcttatggcaaacctagtaagcatgcagtcatcactttctgatgttaacaagttggtcaaggagatccggtctgatgtttctgaagtagttgcagctgacgagtttgagtacaaggatcctgttg

SEQ ID NO: 1294 - DNA, 245 bp, Zea mays
gagatccggtctgatgtttctgaagtagttgcagctgacgagtttgagtacaaggatccagttgatggctctgtgtccaagcaccagggcatccgatacctcttcggagatggttcacgactggtgttccgtctatccggaaccggttctgttggtgccaccatccgtgtctaattgggcaatacgagaagggttcctccaagaccggcagggattcacaggaggcccttgctccactggttgat

SEQ ID NO: 1295 - DNA, 214 bp, Zea mays
cttggaggacataagcttgtcactgttcaacatattcgtccgccagcactgggccacatacggtcgccactactacacacgctaccgccacgagaacgctgatgcacgggctgctaaggaccttacgcgcaaacctagtaaccgtgcagtcatcactttctgatgctaacaagctggtcaaggagatccggtctgatgtcttctgaagtacctg

SEQ ID NO: 1296 - DNA, 226 bp, Zea mays
cccacgcgtccgcccacgcgtccggaagggagttgccaggagcatgccaacatctgctgctcttgatgttgttgcaaagaatttgaaccttaagttctttgaggtgcctactggatggaagttttttgggaatttgatggatgctggaatgtgctcaatctgtggtgaagagagctttggcactgggtctgaccacattcgtgagaaggatggcatctgggctgtg

SEQ ID NO: 1297 - DNA, 199 bp, Zea mays
ccttggaggagataagcttgtcactgtcgaagatattgtccgtcagcactgggccacatatggtcgccattactacacacgctatgactatgagaatgttgatgcaggggctgctaaggagcttatggcaaacctagtaagcatgcagtcatcactttctgatgttaacaagttggtcaaggagatccggtctgatgtt

SEQ ID NO: 1298 - DNA, 297 bp, Zea mays
gttctagatcgcgatctgccgcccttttttttttttttttttttgctcaaacaaaaccagaaacacttcctaacaagattacaagaaacacgctcccgattacagcactgtcaatgtgacaagattattaccgcatgctgtgccagcggctcagtccgctgcactgcagtacatggacaaaaaaaaaacggggcgagtctgatacatacattttattcattggtgagatgcaacaggaagtagaactatagaacaagaggcttgaatgaaaatttgtgtaagcgcctcaactcattg

SEQ ID NO: 1299 - DNA, 310 bp, Zea mays
  unsure (1)..(310): unsure at all n locations
atcatttctatacacacaacagtanacatgtcagcaacctcttgtattgttatgttagatggataaattctgttaacatgtggtatatanatggggccaatcacttgtgttctgaccacattcgtgagaaggatggcatctgggctgtgcttgcatggctttcaattattgctttcaagaataaggacaaccttggaggagataagcttgtcactgttgaagatattgtccgtcagcactgggccacatatggtcgccattactacacacgctatgactatgagaatgttgatgcaggggctgctaagga

SEQ ID NO: 1300 - DNA, 211 bp, Zea mays
agtacctacagggtggaaattttttgggaatttgatggatgctggaatgtgctcaatctgtggtgaagaaagctttggcactgggtctgaccacattcgtgagaaagatggcatctaggctgtgcttgcatggctttctattattgctttcaagaataaggacaaccttggaggagataagcttgtcactgttgaagatattgtccgtcag

SEQ ID NO: 1301 - DNA, 218 bp, Zea mays
  unsure (1)..(218): unsure at all n locations
tgagcgccattactacacacgctatgactatgagatgttgatgcaggggctgctaaggagcttatggcaaacctagtaagcatgcagtcatcactttctgatgttaacaagttgtttncaggagatcggtctgatgtttctgatgtagttgcagctgacgagtttgagtacaaggatcctgttgatggctctgtgtccaagcaccagggcatccgata

SEQ ID NO: 1302 - DNA, 173 bp, Zea mays
actattattgctttcaatcataaggacaaacttggaagagataagcttgtcactgttgaagatattgtccgtcagcattgggcgacatatggtcgccattattacacacgctatgactatgagaatgtcgatgctggggctgctaaggcgctgatggcaaacctaataagcat

SEQ ID NO: 1303 - DNA, 264 bp, Zea mays
ccctctcccttttttttttttgagtaaattatttttagtactcagaaaaaaagataagcaaatgctcaaacaaaaccagaaacacttcctaacaagattacaagacacacgctcccgattacagcactgtcactgtgacaagattattaccgcatgctgtgccagcggctcagtccgctgcactgcagtacatggacaaaaaaaaaacggggcgagtctgatacatacattttattcattggtgagatgcaacaggaagtagaa

SEQ ID NO: 1304 - DNA, 198 bp, Zea mays
gcacgaggttgcatctcaccaatgaataaaatgtatgtatcagactcgccccgttttttttttgtccatgtactgcagtgcagcggactgagccgctggcacagcatggcggtaataatcttgtcacagtgacagtgctgtaatcgggagcgtgtttcttgtaatcttgttaggaagtgtttctggttttgtttgagc

SEQ ID NO: 1305 - DNA, 303 bp, Zea mays
caaatgaccatctggaacactgtttctgctaatgccagccttttcatcttctgcttgtatgcagctgtccggtcttagatgcatttgaaatttctctatgcactgaacactacttatgttattccattattgtaataacaggagcatgccaacatctgctgctcttgatgttgttgcaaagaatttgaaccttaagttctttgaggtgcctactggatggaagtttttttgggaatttgatggatgctggaatgtgctcaatctgtggtgaagaaagctttggcactgggtctgaccacattc

SEQ ID NO: 1306 - DNA, 122 bp, Zea mays
ctttctgatgttaacaagttggtcaaggagatccggtctgatgtttctgaagtagttgcagctgacgagtttgagtacaaggatcctgttgatggctctgtgtccaagcaccagggcatccg

SEQ ID NO: 1307 - DNA, 118 bp, Zea mays
  unsure (1)..(118): unsure at all n locations
cggtctgatgtntctgaagtagtgcagctgacgagtntgagtacaaggatcctgttgatggctctgtgtccaagcaccagggcatccgatacctctttggagatggttcacgactggt

SEQ ID NO: 1308 - DNA, 291 bp, Zea mays
caaatgaccatctggaacactgtttctgctaatgccagccttttcatcttctgcttgtatgcagctgtccggtcttagatgcatttgaaatttctctatgcactgaacactacttatgttattccattattgtaataacaggagcatgccaacatctgctgctcttgatgttgttgcaaagaatttgaaccttaagttctttgaggtgcctactggatggaagtttttttgggaatttgatggatgctggaatgtgctcaatctgtggtgaagaaagctttggcactgggt

SEQ ID NO: 1309 - DNA, 104 bp, Zea mays
caactctaagaccggcagggattcacaggacgcccttgcaccgcaggttgatgtagcgctcaagctcaccaagatgcaagagtacacaggacgctcagccccca

SEQ ID NO: 1310 - DNA, 321 bp, Zea mays
tgctcctccgccgggacgccgtcagccgcccaggcgctcaagatcagttcaatcccgaccaagccagttgaggggcagaagactgggactagtggcctgaggaaaaaggtgaaagtattccagcaggagaactaccttgctaattggattcaggctctattcaattccttgccccctgaagattatgtgggtgcaacccttgtacttgggggtgatggccggtactttaacaaggaggctgctcagatcatcattaagattgcagctggaaatggagttcagaagatcatagttggcaggaatggtctactgtcaacacct

SEQ ID NO: 1311 - DNA, 306 bp, Zea mays
ccacgcgtccgccacgcgtccgcccacgcgtccgccacgcgtccgggacctgggatattccagcaggagaactaccttgctaattggattcaggctctattcaattccttgccccctgaagattatgtgggtgcaaccttgtacttgggggtgatggccggtactttaacaaggaggctgctcagatcatcattaagattgcagctggaaatggagttcagaagatcatagttggcaggaatggtctactgtcaacacctgctgtatctgctgtaattcgtaaaagaaaagccaatggcggcttta

SEQ ID NO: 1312 - DNA, 311 bp, Zea mays
cttgtacttgggggtgatggccggtactttaacaaggaggctgctcagatcatcattaagattgcagctggaaatggagttcagaagatcatagttggcaggaatggtctactgtcaacacctgctgtatctgctgtaattcgtaaaagaaaagccaatggcggctttatcatgagtgcaagccataatccaggtggaccagacaatgactggggtattaagtttaactacagcagtggacagccagcaccggagacgattactgatcaaatttatggaaacacactatcaatttctgaaataaaaacagc

SEQ ID NO: 1313 - DNA, 265 bp, Zea mays
ttcagaagatcatagttggcaggaatggtctactgtcaacacctgctatatctgctgtaattcgtaaaagataagccaatggcggctttatcatgagtgcaagccataatccaggtggaccagacaatgactggggtattaagtttaactacagcagtggacagccagcaccggagacgattactgatcaaatttatggaaacacactatcaatttctgaaatacaaacagcagacattcctgatactgatttgtcctctgttgg

SEQ ID NO: 1314 - DNA, 302 bp, Zea mays
cgtcatcacataaattttgaagaacgttttagaatgagttgaggcgcttacacaaactttcattccggcctcttgttccatagtttttcttgcatgttacatctcaccgatgaataaaatgtatgtatcagacttgtctcgtttttttgcccatccaagcagcaaattagccgctggcacagcatgcggtaataatcttgtcacagtgctgtaattgggagcgtttttcttgttagaagtgtttctggtttgtttgagcatttgcgtatcgatttttctttctgaagagtataaattatttt

SEQ ID NO: 1315 - DNA, 300 bp, Zea mays
tctcactcccgtgtcgtgtctagcgccgacgggttgctaccggagccggccagcggccacgatgcctacaatgcacgcgcttcgcctatgcccgctgctctccaccatccgatccacaccaccgcgggccactgccgcagcccgccaggcgcgctcttcgtcgcccgctgctcctccgccgggacgccgtcagccgcccaggcgctcaagatcagttcaatcccgaccaagccagttgaggggcagaagactgggactagtggcctgaggaaaaaggtgaaagtattccagcaggagaac

SEQ ID NO: 1316 - DNA, 356 bp, Zea mays
  unsure (1)..(356): unsure at all n locations
cgatccctgcaccactaccgcctcctccgcttcacccctctcgtcgcctcttgcggcgaccggcggcggatcgtccgcggcngcaacgcaaccatggggctcttcaccgtgacgaagaaggccaccacccccttcgaaggccagaagcccggtacctccggcctccgcaagaaggttactgtattccagcagcctcattatctgcagaactttgtccagtcaacattcaatgcccttcctgcagaccaagtaaaaggtgcaaccattgttgtctctggtgatggccgctatttctcaaaagatgctgttcagatcataacaanaatggctgctgccaatggagtaagacgtgtttg

SEQ ID NO: 1317 - DNA, 304 bp, Zea mays
ctgtcatccgtgaaagaattggtgcagatggatcaaaggctactggtgccttcatcttgacagcgagccataacccaggtggtcctacggaggactttggtatcaaatacaatatgggaaatggtggacctgcccctgaatccgttaccgacaagattttctctaatacaacgacaatctctgaatacctcatctctgaagaccttccagatgttgatatttctgttgtcggtgtcaccagcttcagtggacccgaagcccctttgatgtggatgtctttgactctagtgtaaattacataaag

SEQ ID NO: 1318 - DNA, 307 bp, Zea mays
cccacgcgtccgggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagagttggtgcagatggatcaaaggctactggtgccttcatcttgacagcgagccataacccaggtggtcctaaggaggacttcgggatcaaatacaacatgggaaatggtgggcctgctcctgaatctgttaccgacaagattttctctaatacaacga

SEQ ID NO: 1319 - DNA, 292 bp, Zea mays
aagcccggtacctccggcctccgcaagaaggttactgtattccagcagcctcattatctgcagaactttgtccagtcaacattcaatgcccttcctgcagaccaagtaaaaggtgcaaccattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagaattggtgcagatggatcaaagg

SEQ ID NO: 1320 - DNA, 294 bp, Zea mays
gcagaactttgtccaatcaacattcaatgcccttcctgtggatcaagtaagacgtgcaacaattgttgtctctggtgatggccgctatttctcaaaagatgctgttcagatcataacaaaaatggctgctgccaatggagtaagacgtgtttgggttggacaaaacagtctcatgtctactcctgctgtaactgctgtcatccgtgaaagagttggtgcagatggatcaaaggctactggtgccttcatcttgacagcgagccataacccaggtggtcctaaagaggacttcgg

SEQ ID NO: 1321 - DNA, 312 bp, Zea mays
cctctcactcccgatccctgcaccactaccgcctcctccgcgtcacccctctcgtcgcctcttgcggcgaccggcggcggatcgtccgcagcgcaagcgcaaccatggggctcttcaccgtgacgaagaaggccaccacccccttcgaaggccagaagcccggtacctccggcctccgcaagaaggttactgtattccagcagcctcattatctgcagaactttgtccagtcaacattcaatgcccttcctgcagaccaagtaaaaggtgcaaccattgttgtctctggtgatggccgctatttctcaaaag

SEQ ID NO: 1322 - DNA, 284 bp, Zea mays
gtgcagatggatcaaaggctactggtgccttcatcttgacagcgagccataacccaggtggtcctaaggaggacttcgggatcaaatacaacatgggaaatggtgggcctgctcctgaatctgttaccgacaagattttctctaatacaacgacaatctctgaatacctcatctctgaagacctaccagatgttgatatttctgttgtcggtgtcaccagcttcagtggacccgaaggcccctttgatgtggatgtttttgactctagtgtagattacataaag

SEQ ID NO: 1323 - DNA, 310 bp, Zea mays
tatgcagatggatcaaaggctactggtgccttcatcttgacagcgagccataacccaggtggtcctacggaggactttggtatcaaatacaatatgggaaatggtggacctgcccctgaatccgttaccgacaagattttctctaatacaacgacaatctctgaatacctcatctctgaagaccttccagatgttgatatttctgttgtcggtgtcaccagcttcagtggacccgaaggcccctttgatgtggatgtctttgactctagtgtaaattacataaagttaatgaagacaatttttgacttcg

SEQ ID NO: 1324 - DNA, 296 bp, Zea mays
ccgatccctgcaccactaccgcctcctccgcttcacccctctcgtcgcctcttgcggcgaccggcggcggatcgtccgcagcgcaacgcaaccatggggctcttcaccgtgacgaagaaggccaccacccccttcgaaggccagaagcccggtacctccggcctccgcaagaaggttactgtattccagcagcctcattatctgcagaactttgtccagtcaacattcaatgcccttcctgcagaccaagtaaaaggtgcaactattgttgtctctggtgatggccgctatttctc

SEQ ID NO: 1325 - DNA, 265 bp, Zea mays
gaaatggtgggcctgctcctgaatctgttaccgacaagattttctctaatacaacgacaatctctgaatacctcatctctgaagacctaccagatgttgatatttctgttgtcggtgtcaccagcttcagtggacctgaaggcccctttgatgtggatgtttttgactctagtgtagattacataaagttaatgaagtcaatttttgacttcgaagcaataaaaaagctgctgacctccccaaagtttacattctgttatgatgc

SEQ ID NO: 1326 - DNA, 281 bp, Zea mays
  unsure (1)..(281): unsure at all n locations
cctcactgccctctcactcccgatccctgcaccactaccgcctcctccgcgtcacccctctcgtcgcctcttgcggcgaccggcggcggatcgtccgcagcgcaagcgcaaccatggggctcttcaccgtgacgaagaaggccaccacccccttcgaaggccagaagcccggtacctccggcctccgcaagaaggttactgtattccagcagcctcattatctgcagaactttgtccagtcaacattcaatgcccttcctgcagaccaagtanaaggtgca

SEQ ID NO: 1327 - DNA, 250 bp, Zea mays
  unsure (1)..(250): unsure at all n locations
gtcctaaggaggacttcgggatcaaatacaacatgggaaatggtgggcctgctcctgaatctgttaccgacaagattttctctaatacaacgacaatctctgaatacctcatctctgaagacctaccagatgttgatatttctgttgtcggtgtcaccagcttcagtggacccganatcccctttgatgtggatgtttttgactctagtgtagattacataaagttaatgaagacaatttttgacttcga

SEQ ID NO: 1328 - DNA, 255 bp, Zea mays
gaaatggtgggcctgctcctgaatctgttaccgacaagattttctctaatacaacgacaatctctgaatacctcatctctgaagacctaccagatattgatatttctgttgtcggtgtcaccagcttcagtggacctgaaggcccctttgatgtggatgtttttgactctagtgtagattacataaagttaatgaagtcaatttttgacttcgaagcaataaaaaagctgctgacctccccaaagtttacattct

SEQ ID NO: 1329 - DNA, 267 bp, Zea mays
cccacgcgtccgccactccttccctgccctctcactcccgatccctcctccaccaccgcttcctccgcgtcacccctctcgtcgtcgcctcacgaggcgaccagcggcggaccctccgcggcgcaaccatggggctcttcactgtgacgaagaaggccaccacgcccttcgacggccagaagcccggcacctccggcctccgcaagaaggttactgtattccagcagccccattatctgcagaactttgtccaatcaacattcaatg

SEQ ID NO: 1330 - DNA, 308 bp, Zea mays
cggaccgtggcggaaatagtgaggagcggagaacaccggaatgatccatcctcttgtgctttccctgcccttccccgctataatatcgcgccctcgtcagcatcgtcaccacaccagcactccctcactgccctctcactcccgatccctgcaccactaccgcctcctccgcttcagccctctcgtcgcctcttgcggcgaccggcggcggatcgtccgcggcgcaacgcaaccatggggctcttcaccgtgacgaagaaggccaccacccccttcgaaggccagaagcccggtagctccggcctccg

SEQ ID NO: 1331 - DNA, 244 bp, Zea mays
gaaatggtgggcctgctcctgaatctgttaccgacaagattttctctaatacaacgacaatctctgaatacctcatctctgaagacctaccagatgttgatatttctgttgtcggtgtcaccagcttcagtggacccgaagcccctttgatgtggatgtttttgactctagtgtagattacataaagttaatgaagacaatttttgacttcgaagcaataaaaaagctgctgacctccccaaag

SEQ ID NO: 1332 - DNA, 266 bp, Zea mays
ccatcctctcgtgctatccctgccctcccccgctataatatcgcgccctcgtcgccatcgtcaccacaccaccactccctcactgccctctcactcccgatccctgcaccactaccgcctcctccgcgtcacccctctcgtcgcctcttgcggcgaccggcggcggatcgtccgcggcgcaacgcaaccatggggctcttcaccgtgacgaagaaggccaccacccccttcgaaggccagaagcccggtacctccggcctccgcaa

SEQ ID NO: 1333 - DNA, 221 bp, Zea mays
ggagtaagacgtgtttgggttggacaaaacagtctcatgtctactcctgctgtatctgctgtcatccgtgaaagagttggtgcagatggatcaaaggctactggtgccttcatcttgacagcgagccataacccaggtggtcctaaggaggacttcgggatcaaatacaacatgggaaatggtgggcctgctcctgaatctgttaccgacaagattttctc

SEQ ID NO: 1334 - DNA, 230 bp, Zea mays
ctgccctctcactcccgatccctgcaccactaccgcctcctccgcttcacccctctcgtcgcctcttgcggcgaccggcggcggatcgtccgcggcgcaagcacaaccatggggctcttcaccgtgacgaagaaggccaccacccccttcgaaggccagaagcccggtacctccggcctccgcaagaaggttactgtattccagcagcctcattatctgcagaactttgt

SEQ ID NO: 1335 - DNA, 271 bp, Zea mays
ctgcaccactaccgcctcctccgcgtcacccctctcgtcgcatcttgcggcgaccggcggcggatcgtccgatgcgcacgcgtaacactggggctcttcaccgtgacgaagaaggccaccacccccttcgaaggccagaagcccggtacctccggcctacgcaagaaggttactgtattccagcagcctcattatctgcagaacttggtccagtcaacattcaactgccttcctgcagaccaagtaaaaggtgcaccattgttgtctctgg

SEQ ID NO: 1336 - DNA, 238 bp, Zea mays
cctccgcgtcacccctctcgtcgcctcttgcggcgaccggcggcggatcgtccgcggcgcaacgcgaccatggggctcttcaccgttccgaagaaggtcaccatccccttcgaaggccagaagcccggtacctccggcctccgcaagaaggttactgtattccagcagcctcattagctgcagagctttgtcgagtcaacattcaatgtccttcctgcagaccaagtaaaatgtgcac

SEQ ID NO: 1337 - DNA, 163 bp, Zea mays
ctctcactcccgatccctgcaccactaccgcctcctccgagtcacccctctcgtcgcctcttgcggcgaccggcggcggatcgtccgcagcgcaacgcaaccatggggctcttcaccgtgacgaagaaggccaccacccccttcgaaggccagaagcccggta

SEQ ID NO: 1338 - DNA, 224 bp, Zea mays
gaatggtgggctgctcctgaatctgttaccgacaagattttctctaatacaacgacaatctctgaatacctcatctctgaagacctaccagatgttgatatttctgttgtcggtgtcaccagcttcagtgagaccgaaggccctttgatgtggatgttttgactcaagtgtagattacataagtaatgaagcaattttgactcgaagcataaaaaactgtgact

SEQ ID NO: 1339 - DNA, 192 bp, Zea mays
ctgccctctcactcccgatccctgcaccactaccgcctcctccgcttcacccctctcgtcgcctcttgctgcgaccggcggcggatcgtccgcagcgcaagcgcaaccatggggctcttcaccgtgacgaagaaggccaccacccccttcgaaggccagaagcccggtacctccggcctccgcaagaaggtt

SEQ ID NO: 1340 - DNA, 141 bp, Zea mays
gcctccctgccctctcactcccgatccctcctccaccgccgcttcctccgcgtcacccctctcgtagtcgcctcacgaggcgaccagcggcggaccctccgcggcgcaaccatggggctcttcactgtgacgaagaaggcc

SEQ ID NO: 1341 - DNA, 255 bp, Zea mays
gcgagatcaatgccaaccagtggtgctcttgatcgtgttgccgagaaattgaatgttccattctttgaggttccaacaggctggaaattttttggcaacctaatggatgcaggaaaattgtctatttgtggagaggaaagttttgggactggatctgatcacatcagagagaaggatggcatctgggctgttctggcttggctttccatacttgcacaccggaacaaggataagaaggtcggagagagattagtg

SEQ ID NO: 1342 - DNA, 273 bp, Zea mays
  unsure (1)..(273): unsure at all n locations
gnatcgtgttgccgagaaattgaatgttccattctttgaggttccaacaggctggaaatttacctgcatccattaggttgccaaaaaattgtctatttgtggagaggaaagttttgggactggatctgatcacatcagagagaaggatggcatctgggctgttctggcttggctttccatacttgcacaccggaacaaggataagaaggtcggagagagattagtgtcanttgaggatattgctatggagcactggaaancctatggcnggat

SEQ ID NO: 1343 - DNA, 268 bp, Zea mays
ctcatctctgaagaccttccagatgttgatatttctgttgtcggtgtcaccagcttcagtggacccgaaggcccctttgatgtggatgtctttgactctagtgtaaattacataaagttaatgaagacaatttttgacttcgaagcaataaaaaagctactgacctccccaaagtttacattctgttatgatgcgctccatggtgttgctggagcttatgccaaacacatctttgtggaagagcttggtgctgatgaaagctcactgt

SEQ ID NO: 1344 - DNA, 236 bp, Zea mays
catctctgaagacctaccagatgttgatatttctgttgtcggtgtcaccagcttcagtggacccgaagcccctttgatgtggatgtttttgactctagtgtagattacataaagttaatgaagacaatttttgacttcgaagcaataaaaaagctgctgacctccccaaagtttacattctgttatgatgcactccatggtgttgcgggacttatgccatacacatctttgtggaa

SEQ ID NO: 1345 - DNA, 433 bp, Zea mays
cccacgcgtccgctgataccgtactaccgtctacaggatcagtatagctgaaggcatgagcaaattggagggtgtagacggtagtacggtatcaaaacaaggacttcgatttgttttcactgatggatctaggattatcttccggctttcgggaaccggatctgctggagctactatccgcctctacatagaacaatttgaatctgatatctcgaagcatagtctcgatgctcaaacagctttgaagcctttaatagacctggctttgtctgtttcgaagctcaaggacttcacaggaagagagaaacctactgtcataacataggccctgtttgtttcggcttttggcagcttctggccaccaaaagctactgcgtactgtcaaacgctcagcttttcagccagcttctataaaattcggttggggcaaaaa

SEQ ID NO: 1346 - DNA, 408 bp, Zea mays
gtacgtgcgtgactacagttgcatgctatggccatggccacgacttcgccggcaactgggcagccatcatcatacaagcacacgagccgcggcgcggcgcggtgctgccctcctcctctgctgtcctggaagacacgaagctttgggcagcaggtgacgacaagggccacggcggcgagctcccgtgggcagcccgccggcgtggcactggcagggggagaagagggcgacagtatcaggcggctgcagaacgggtcggacgtgcggggcgtcgcgctggagggcgagaaaggccgggccgtggacctcacgccgctggcggtcgaggccatcgccgagagcttcggggagtggctgcgagaggaggagctccggctccggggccaggagcccgagcagctgcgtgtg

SEQ ID NO: 1347 - DNA, 431 bp, Zea mays
cccacgcgtccggcttggtgctgatgaaagctcactgttgaattgtgtcccgaaagaggactttggaggtggtcatccggatcctaaccttacctatgcaaaagagttggttgaacgcatgggtcttggaaagtcatcctcaaatgttgagcctcctgaatttggtgctgcagctgatggagatgctgaccgcaacatgattcttggtaaaagattctttgtgacaccgtcggactctgttgccattatcgcagccaatgctgttcaatcaattccttactttgcttctggcctgaaaggagttgccaggagcatgccaacatctgctgcccttgatgttgttgcaaagaatttgaaccttaagttctttgaggtgcctactggaatgaagttttttgggaatttgatggatgctggaatgtgctcaatct

SEQ ID NO: 1348 - DNA, 418 bp, Zea mays
gtccgtcagcactgggccacatatggtcgccattactacacacgctatgactatgagaatgttgatgcaggggctgctaaggagcttatggcaaacctagtaagcatgcagtcatcactttctgatgttaacaagttggtcaaggagatccggtctgatgtttctgaagtagttgcagctgacgagtttgagtacaaggatcctgttgatggctctgtgtccaagcaccagggcatccgatacctctttggagatggttcacgactggtgttccgcctctctggaaccggttctgttggtgccaccatccgtgtctacatcgagcagtacgagagggactcctctaagaccggcagggattcacaggacgcccttgcttcgctggttgatgttgcgctcaagctcttcaagatgcaag

SEQ ID NO: 1349 - DNA, 359 bp, Zea mays
ggcctgaagggagttgccaggagcatgccttcatctgctgcccttgatgttgttgcaaagaatttgaaccttaagttctttgaggtgcctactggatggaagttttttgggaatttgatggatgctggaatgtgctcaatctgtggtgaagaaagctttggcactgggtctgaccacattcgtgagaaggatggcatctgggctgtgcttgcatggctttcaattattgctttcaagaataaggacaaccttggaggagataagcttgtcacttgtgaagatattgtccgtcagcactgggccacatatggtcgccattactacacacgctatgactattaaaatgttgatgcacgggc

SEQ ID NO: 1350 - DNA, 421 bp, Zea mays
ctgaatttggtgctgcagctgatggagatgctgaccgcaacatgattcttggtaaaagattctttgtgacaccgtcggactctgttgccattatcgcagccaatgctgttcaatcaattccttactttgcttctggcctgaagggagttgccaggagcatgccaacatctgctgcccttgatgttgttgcaaagaatttgaaccttaagttctttgaggtgcctactggatggaagttttttgggaatttgatggatgctggaatgtgctcaatctgtggtgaagaaagctttggcactgggtctgaccacattcgtgagaaggatggcatctgggctgtgcttgcatggctttcaattattgctttcaagaataaggacaaacttggaggagataagcttgtcactgttgaagatattgt

SEQ ID NO: 1351 - DNA, 377 bp, Zea mays
gggagttgccaggagcatgccaacatctgctgcccttgatgttgttgcaaagaatttgagccttgagttctttgaggtgcctactggatggaagctttttgggaattggatggatgctggaatgtgctcaatctgtggtgaagaaagctttggcactgtggctgaccacattcgtgagaaggatggcatttgggctgagcttgcatggctatcaattattgctttcaagagtttggacagccttgtaggagataagcttgtcactgatgaagatatgtgtcgctagcactggtccacatatggtcgctatttctacactcgctatgactatgagaatttttatgcacgggctgctaatgagcttattgcttacctag

SEQ ID NO: 1352 - DNA, 343 bp, Zea mays
gactggtgttccgcctctctgggaccggttctgttggtgccaccatccgtgtctacatcgagcagtacgagagggactcctctaagaccggcagggattcacaggacgcccttgctccgctggttgatgttgcgctcaagctctccaagatgcaagagtacactggacgctctgcccccaccgtcatcacataaattttgaagtgttttagaatgagttgaggcgcttacacaaactttcattccggcctcttgttccatagtttttcttgcatgttacatctcaccgatgaataaaatgtatgtatcagacttgtctcgttaaaaaaaaaaagaaataaaaa

SEQ ID NO: 1353 - DNA, 293 bp, Zea mays
gccaaacacatctttgtggaagagcttggtgctgatgaaagctcactgttgaattgtgtcccgaaagaggactttggaggtggtcatccggatcctaaccttacctatgcaaaagagttggttgaacgcatgggtcttggaaagtcatcctcaaatgttgagcctcctgaatttggtgctgcagctgatggagatgctgaccgcaacatgattcttggtaaaagattctttgtgacaccgtcggactctgttgccattatcgtaaccaatggctgtcaatcaattccttactt

SEQ ID NO: 1354 - DNA, 464 bp, Zea mays
  unsure (1)..(464): unsure at all n locations
aggatggaggcaatggggaggaggagagaaatgtaaactcnaanccgggggggagcacgcgttccgggcaaaacatatttttgggaaaaacctttttctgatttaaggttacaggtagaatggggtcccgaaggaggcctttgaaggtggcaatccgattcctaacctaactattccaaaaaagttggtggaccccttggtcttggaaaagcaatcctaaatggtgagccctctggattttgtgctgcagcttatggagatgctgaccgcaacatgattcttggtaaaagattctttgtgacaccgtcggactctgttgccattatcgcagccaatgctgttcaatcaattccttactttgcttctggcctgaagggagttgccaggagcatgccaacatctgctgcccttgatgttgttgcaaagaatttgaaccttaagttctttgaggtgcctactggatg

SEQ ID NO: 1355 - DNA, 136 bp, Zea mays
gatccggtctgatgtttctgaagtagttgttgctgacgagtttgagtacaaggatgctgtggatggctctgtgtccaagcaccagggcatccgatacctctttggagatggttcacgactggtgttccgcctctct

SEQ ID NO: 1356 - DNA, 280 bp, Zea mays
atgagttgaggcgcttacacaaactttcattccggcctcttgttccatagtttttcttgcatgttacatctcaccgatgaataaaatgtatgtatcagacttgtctcgtttttttgcccatccaagcagcaaattagccgctggcacagcatgcggtaataatcttgtcacagtgctgtaattgggagcgtttttcttgttagaagtgtttctggtttgtttgagcatttacggatcgatttttctttctgaagagtatataaacattttactcacctgt

SEQ ID NO: 1357 - DNA, 221 bp, Zea mays
gagttgaggcgcttacacaaactttcattccggcctcttgttccatagtttttcttgcatgttacgtctcaccgatgaataaaatgtatgtatcagacttgtctcgtttttttgcccatccaagcagcaaattagccgctggcacagcatgcggtaataatcttgtcacagtgctgtagttgggagcgtttttcttgttagaagtgtttctggtttgtttg

SEQ ID NO: 1358 - DNA, 350 bp, Zea mays
actcacacccgatccctcttccaccaccggcttcctccgcgtcacccctcctcgtccgtcgcctcacaaggcgaccagcgggcggaccctccgcggcgcaaccatggggctcttcactgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcatcacaaaaatggctgctgccaatg

SEQ ID NO: 1359 - DNA, 409 bp, Zea mays
agccatcgcgtccgactccttccctgccctctcactccaaatccctcctccaccaccgcttcctccgcgtcacccctctcgtcgtcgcctcacgaggcgaccagcggcggaccctcgggggcgcaaccatggggctcttcactgtgacggggaaggccaccacgcccttcgacggccagaagcccggcacctccggcctccgcaagaaggttactgtattccagcatccccattatctgcagaactttgtccaatcaacattcaatgcccttcctgtggatcaagtaagaggtgcaacaattgttgtctctggtgattttttctatttctcaaaagatgctgttcagatcataacaaaaatggctgctgccaatggagtaacacgtgtttgggttggacaaaacaatct

SEQ ID NO: 1360 - DNA, 396 bp, Zea mays
  unsure (1)..(396): unsure at all n locations
cccacgcgtccgcccacgcgtccgggaaatcactccagaattttgaaaaggtgacggaaatagtgaggagcggagaacaccggaatgatccatcctctcgtgctatccctgccctcccccgctataatatcgcgccctcgtcgccatcgtcaccacaccaccactccctcactgccctctcactcccgatccctgcaccactaccgcctcctccgcgtcacccctctcgtcgcctcttgcggcgaccggcggcggatcgtccgctgcgcaagcgcaaccatggggctcttcaccgtgacgaagaaggccatcacccccttcgaaagccagaagcccggtacctnctgcctncgcaagaaggttactgtattccagcagcctcattatctgcagaac

SEQ ID NO: 1361 - DNA, 138 bp, Zea mays
caacactaacaacttgtgggtgaaccttaaagctgtcaagagactagtagagctgagcacttaagatggaattatcaacccagaagtgatgggaatctcacttgactgatggacattcgtcttcaacgtgatagtccg

SEQ ID NO: 1362 - DNA, 264 bp, Zea mays
cgttcaagaaggttgggagcttccttggtcgcttcaagtccatacctagcattgttgagcttgacatcttgaaggtttccggtgatgtttggttcggttctggaattgtactgaaggggaaagtgaccatcactgcaaaacctggcgtcaagctagaaatcccagacggagcagtgattgggaataaggataattttggaaaaggaaagagaaaacaataccagatgccttacaacctgaattagggatgaaactgctaattgc

SEQ ID NO: 1363 - DNA, 295 bp, Zea mays
gtcttaggttattatagaagttaaaatgttattccaatgaggcaatgactactcacaatggaatatcaccttgcttgttggattatttacggtgaagacttttagatatagtttgaactgtacctcatttatagcgtatttacataaatgtgatacccatctgattgttgtgatttttgatgtgtaaggtatcctcctggtcatggtgatgtgtttccttctttgaataacagcggaaaacttgacatcttattggctcagggcaaggagtatgtctttgttgcaaactcagaca

SEQ ID NO: 1364 - DNA, 275 bp, Zea mays
agtcaaacctctatagtcttaatgcaggatctcggacaatgagtgacaagcgggaatttcctacagtgcccttggttaaattaggcagttcttttacgaaggttcaagattatctacgaagatttgaaagtataccagatatgcttgaattggatcacctcacagtctcaggagatgtgacatttggaaaaaatgtttcattacagggaacggttatcatcattgcatatcatggtgacacttttgatatccctcctggagcagtattagagcac

SEQ ID NO: 1365 - DNA, 283 bp, Zea mays
gtggagtgaaaccctaggtttaccgtggaagaagaaagtccattcggcgcgctctaggtgtttggcaaaaagcttaaaccggaaatcgtcatcgcccttacacatatcgatttggtttatgacatgtctgatctatataccttggttgatggcttcgttacacgtaattcagctaggactttagggcaaagtgatcatcactgcaaaacctggcgtcaagctagaaatcccagacggagcagtgattgggaataagattccaagttcacacagcaggagttgc

SEQ ID NO: 1366 - DNA, 234 bp, Zea mays
gacaaatccatcaaatccctcaattgaacttagtcctgagttcaagaaggttgcggagcttccttggtcgcttcaagtcgatacctagcattcactgacagcttgaaggtttccggtgatgtttggttcggttctggacttgtattgaaggggacagtgaccatcactgcaaaacctggcgtcaagctagaaatcccagacggagcagtgattgggaatacggatatcagtggc

SEQ ID NO: 1367 - DNA, 212 bp, Zea mays
ctccaacattgcaattcatactttcaatcagagccagtatcctcgcattgttaccgaggacttcttgccacttccaagcaaagggacatcttggaaggatggctggtatcctccaggccatggtgatgtgttcccctctttgaataacagtggaaaactcgacatcttattggctcagggcaaggagtatgtcttcgttgctaactagacaa

SEQ ID NO: 1368 - DNA, 274 bp, Zea mays
cccggcgtcagacgcgcatcttccagcaatggcggacgagaagctgccaactgcgcgaagcaccgccggcctcacgcagatcagcgataacgagaagtccggcttcctcagcctcgtcggccgctacctcagcggcgacgaggagcacatcgagtgggccaagatccacacgcccaccgacgaggtggtggtgccgtacgacaccctggagtccccgccagaaggcactgaggcgaccaagaagctgctcgacaagctcgccgtgctcaagctc

SEQ ID NO: 1369 - DNA, 248 bp, Zea mays
ctctcccagatccgtctcccggcgtcagacgcgcatcttccagcaatggcggacgagaagcttgccaagctgcgcgaaccaccgccggcctcacgcagatcagcgagaacgagaagtccggcttcctcagcctcgtcggccgatacctcagtggcgacgaggagcacatcgagtgggccaagatccacacgcccaccgacgaggtggtggtgccgtacgacaccctggagtccccgccagaaggcact

SEQ ID NO: 1370 - DNA, 186 bp, Zea mays
ctcccggcgtcagacgcgcatctccagcaatggcggacgagaaacttgccaagctgcgcgaaccaccgccggcctcacgcagatcagcgagaacgagaagtccggcttcctcagcctcgtcggccgctacctcagcggcgacgaggagcacatcgagtgggccaagatccacacgcccaccgacga

SEQ ID NO: 1371 - DNA, 323 bp, Zea mays
cagttaaagcgacatcagatttgcagctagtacagtctgatctatataccttggttgatggcttcgttacacgtaattcagccagaacaaatccatcaaatccctcaattgaacttagtcctgagttcaagaaggttgggagcttccttggtcgcttcaagtcgatacctagcattgttgagcttgacagcttgaaggtttccggtgatgtttggttcggttctggaattgtattgaaggggaaagtgaccatcactgcaaaacctggcgtcaagctagaaatcccagacggagcagtgattgggaataaggatatcagtggc

SEQ ID NO: 1372 - DNA, 328 bp, Zea mays
cggacgcgtggctgacgcgtgggcggacgcgtgggatgccattggtatcaacgttccaaggtcccgctatcctaccagttaaggcgacatcagcatttgcagctagtacagtctgatctatataccttggttgatggcttcgttacacgtaattcagccagaacaaatccatcaaatccatcaattgaacttggtcctgagttcaagaaggttgggagcttccttggtcgcttcaagtcgatacctagcattgttgagcttgacagcttgaaggtttccggtgatgtttggttcggttctggaatgtactgaacgggaaagtgaccat

SEQ ID NO: 1373 - DNA, 301 bp, Zea mays
ggaccagttctttgaccatgccattggtatcaacgttccaaggtcccgcttcctaccagttaaggcgacatcagatttgcagctagtacagtctgatctatataccttggttgatggcttcgttacacgtaattcagccagaacaaatccatcaaatccctcaattgaacttggtcctgagttcaagaaggttgggagcttccttggtcgcttcaagtccatacctagcattgttgagcttgacatcttgaaggtttccggtgatgtttggttcggttctggaattgtactgaaggggaaa

SEQ ID NO: 1374 - DNA, 349 bp, Zea mays
agagccagtatcctcgcattgttaccgaggacttcttgccacttccaagcaaagggaaatctggtaaggatggctggtatcctccaggccatggtgatgtgttcccctctttgaataacagtggaaaactcgacatcttattggctcaaggcaaggagtatgtcttcattgctaactcagacaacttgggtgctatagtcgacatcaagatcctgaaccatctgatcaataaccagaatgaatactgcatggaggttactccaaaaacattggctgatgttaaaggcggtactctcatctcttacgaaggaagagttcagcttttggagattgcccaagtacctgatga

SEQ ID NO: 1375 - DNA, 357 bp, Zea mays
agttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttgctcggttcaagtccatccccagcatagttgagcttgacagcttgaaggtttctggtgatgtctggtttggctctggaattacactcaagggcaaggtgacaat

SEQ ID NO: 1376 - DNA, 314 bp, Zea mays
gcgagaacgagaagtccgggttcatcagcctcgtgtcacggtacctcagtggggacgctgacagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattcaaattgagtccctgaacaagaagtatggat

SEQ ID NO: 1377 - DNA, 309 bp, Zea mays
ctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattcaaattgagtccctgaacaagaagtatggatgcaatgtccctttacttctgatgaactctttcaacacccatgatgacacacagaagattgttgagaagtattccaactccaacatcgaaattcatactttcaatca

SEQ ID NO: 1378 - DNA, 302 bp, Zea mays
gttgagaagtattccaactccaacattgaaattcatactttcaatcagagccagtatcctcgcattgttaccgaggacttcttgccacttccaagcaaagggaaatctgggaaggatggctggtatcctccaggccatggtgatgtgttcccctctttgaataacagtggaaaactcgacatcttattggctcagggcaaggagtatgtcttcgttgctaactcagacaacttgggtgctatagtcgacatcaagatcctgaaccatctgatcaataaccagaatgaatactgcatggaggt

SEQ ID NO: 1379 - DNA, 319 bp, Zea mays
ccacgcgtccgggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattcaaattgagtccctgaacaagaagtatggatgcaatgtccctttacttctgatgaactctttcaacacccatgatgacacac

SEQ ID NO: 1380 - DNA, 322 bp, Zea mays
cccacgcgtccgatcttattggctcagggcaaagagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggagattgcccaagtacccgatgagcatgtgaatgaatttaaatcaatcgagaagtttaagatattcaacactaacaacttgtgggtgaaccttaaagctatcaagagactcgtagagg

SEQ ID NO: 1381 - DNA, 328 bp, Zea mays
ggttaagatattcaacactaacaacttgtgggtgaaccttaaagctgtcaagagactagtagaggctgaggcacttaagatggaaattattccaaaccccaaggaagttgatggtgtgaaagtccttcaatttgaaactgcagctggtgcagctattcgtttctttgacaaagcgattggaattaatgttccccgctcaagatttctcccagtgaaggctacatctgatttattgcttgtgcagtctgatctttacaccttggtcgatggctttgtcatccgcaacccatccagaacgaatccagctaatccttcgattgagcttgga

SEQ ID NO: 1382 - DNA, 286 bp, Zea mays
aattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttgctcggttcaagtccatccccagcatagttgagcttgacagcttgaaggtttctggtgatgtctggtttggctctggaattacactcaagggcaaggtgacaattatc

SEQ ID NO: 1383 - DNA, 302 bp, Zea mays
caagagactcgtagagctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaa

SEQ ID NO: 1384 - DNA, 305 bp, Zea mays
gcactctcatctcttacgaaggaagagttcagcttttggagattgcccaagtacccgatgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtg

SEQ ID NO: 1385 - DNA, 321 bp, Zea mays
cggacgcgtggggacgagaagctcgataagcttcgcgccgaggtcgccaagctcgaccagatcagcgagaacgagaagtccgggttcatcagcctcgtgtcacggtacctcagtcgggaggcggacagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggt

SEQ ID NO: 1386 - DNA, 307 bp, Zea mays
ctcgagccgctctgcagtccctgaacaagaagtatggatgcaatgtccctttacttctgatgaactctttcaacacccatgatgacacacagaagattgttgagaagtattccaactccaacatcgaaattcatactttcaatcagagccagtatcctcgcattgttaccgaggacttcttgccacttcccagcaaagggaaatctgggaaggatggctggtatcctcctggtcatggtgatgtgtttccttctttgaataacagcggaaaacgtgacatcttattggctcagggcaaggagtatgt

SEQ ID NO: 1387 - DNA, 276 bp, Zea mays
cggagggctcgggacgaccatgggctgcactgggcccaagtctgtcattgaagtccgcaatgggtacacattccttgaccttattgtgattcaaattgagtccctgaacaagaagtatggatgcaatgtccctttacttctgatgaactctttcaacacccatgatgacacacagaagattgttgagaagtattccaactccaacatcgaaattcatactttcatttcagagccagtatcctcgcattgttaccgaggacttcttgccacttccca

SEQ ID NO: 1388 - DNA, 298 bp, Zea mays
tgtccctttacttctgatgaactctttcaacacccatgatgacacacagaagattgttgagaagtattccaactccaacatcgaaattcatactttcaatcagagccagtatcctcgcattgttaccgaggacttcttgccacttcccagcaaagggaaatctgggaaggatggctggtatcctcctggtcatggtgatgtgtttccttctttgaataacagcggaaaacttgacatcttattggctcagggcaaggagtatgtctttgttgcaaactcagacaacttgggtgctata

SEQ ID NO: 1389 - DNA, 287 bp, Zea mays
attgttgagaagtattccaactccaacatcgaaattcatactttcaatcagagccagtatcctcgcattgttaccgaggacttcttgccacttcccagcaaagggaaatctgggaaggatggctggtatcctcctggtcatggtgatgtgtttccttctttgaataacagcggaaaacttgacatcttattggctcagggcaaggagtatgtctttgttgcaaactcagacaacttgggtgctatagtcgacatcaagatcctaaaccatctgatcaataaccagaa

SEQ ID NO: 1390 - DNA, 291 bp, Zea mays
ggaggttactccaaaaacattggctgatgttaaaggcggtactctcatctcttacgaaggaagagttcagcttttggagattgcccaagtacctgatgagcatgtgaatgagtttaaatcaatcgagaagtttaagatattcaacactaacaacttgtgggtgaaccttaaagctgtcaagagactagtagaggctgaggcacttaagatggaaattattccaaaccccaaggaagttgatggtgtgaaagtccttcaacttgaaactgcagctggtgcagctattcgttt

SEQ ID NO: 1391 - DNA, 271 bp, Zea mays
gcttaacggagggctcgggacgaccatgggctgcactgggcccaagtctgtcattgaagtccgcaatgggttcacattccttgaccttattgtgattcaaattgagtccctgaacaagaagtatggatgcaatgtccctttacttctgatgaactctttcaacacccatgatgacacacagaagattgttgagaagtattccaactccaacatcgaaattcatactttcaatcagagccagtatcctcgcattgtaaccgaggacttcttg

SEQ ID NO: 1392 - DNA, 340 bp, Zea mays
tgggttcacattccttgaccttattgtgattcaaattgagtccctgaaaaagaagtatggatgcaatgtcgctttacttctgatggactatttcaacacccatgatgacacacagaagattgttgagaagtattccaactccaacatcgaaattcatactttcaatcagagccagtatcctcgcattgttaccgaggacttcttgccacttcccagcaaagggaaatctgggaaggatggctggtatcctcctggtcatggtgatgtgtttccctctgttgaataacagcggaaaacttgacatcttattggctcagggcaaagagtatgtctttgttga

SEQ ID NO: 1393 - DNA, 257 bp, Zea mays
agctcgttgtgctcaagcttaacggagggctcgggacgaccatgggctgcactgggcccaagtctgtcattgaagtccgcaatgggttcacattccttgaccttattgtgattcaaattgagtccctgaacaagaagtatggatgcaatgtccctttacttctgatgaactctttcaacacccatgatgacacacagaagattgttgagaagtattccaactccaacatcgaaattcatactttcaatcagagccag

SEQ ID NO: 1394 - DNA, 269 bp, Zea mays
caaattgagtccctgaacaagaagtatggatgcaatgtccccttacttctgatgaactctttcaacacccatgatgacacacagaagattgttgagaagtattccaactccaacatcgaaattcatactttcaatcagagccagtatcctcgcattgttaccgaggacttcttgccacttcccagcaaagggaaatctgggaaggatggctggtatcctcctggtcatggtgatgtgtttccttctttgaataacagcggaaaacttga

SEQ ID NO: 1395 - DNA, 264 bp, Zea mays
ctcgcattgttaccgaggacttcttgccacttccaagcaaagggaaatctgggaaggatggctggtatcctccaggccatggtgatgtgttcccctctttgaataacagtggaaaactcgacatcttattggctcagggcaaggagtatgtcttcgttgctaactcagacaacttgggtgctatagtcgacatcaagatcctgaaccatctgatcaataaccagaatgaatactgcatggaggttactccaaaaacattggctg

SEQ ID NO: 1396 - DNA, 297 bp, Zea mays
ggacgcgggcttgtgcagtctgatctttacaccttggttgatggctttgagctccgcaacccatccagagcgaatccagctaacccttcaattgagcttggacctgagttcaagaaggttgccaatttccttgctcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggat

SEQ ID NO: 1397 - DNA, 281 bp, Zea mays
gaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttgctcggttcaagtccatccccagcatagttgagcttgaca

SEQ ID NO: 1398 - DNA, 263 bp, Zea mays
ccagaatgaatactgcatggaggttactccaaaaacattggctgatgttaaaggcggtactctcatctcttacgaaggaagagttcagcttttggagattgcccaagtacctgatgagcatgtgaatgagtttaaatcaatcgagaagtttaagatattcaacactaacaacttgtgggtgaaccttaaagctgtcaagagactagtagaggctgaggcacttaagatggaaattattccaaaccccaaggaagttgatggtg

SEQ ID NO: 1399 - DNA, 288 bp, Zea mays
cccacgcgtccggcccaagtacccgatgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgat

SEQ ID NO: 1400 - DNA, 278 bp, Zea mays
cccacgcgtccgcaagaagtatggatgcaatgtccctttacttctgatgaactctttcaacacccatgatgacacacagaagattgttgagaagtattccaactccaacatcgaaattcatactttcaatcagagccagtatcctcgcattgttaccgaggacttcttgccacttcccagcaaagggaaatctgggaaggatggctggtatcctcctggtcatggtgatgtgtttccctctttgaataacagcggaaaacttgacatcttattggctc

SEQ ID NO: 1401 - DNA, 278 bp, Zea mays
gcgagaacgagaagtccgggttcatcagcctcgtgtcacgctacctcagtggggaagcggacagatcgagtggagcaagatccagacccctacggatgaggtggtggtgccctacgataccgtcgcgtcgcctcccgaagatctcgaggagacgagaagctgctggataagctcgttgtgctcaagcttaacggagggctcgggacgaccatgggctgcactgggcccaagtctgtcattgaagtccgcaatgggttcacattccttgatcttattgt

SEQ ID NO: 1402 - DNA, 282 bp, Zea mays
atctttacaccttggttgatggctttgtcatccgcaatccatccagagcgaatccagctaacccttcgattgagcttggacctgagttcaagaaggttgccaatttccttgctcggttcaagtccatccccagcatcgtcgagcttgacagcttgaaggtttctggtgatgtctggtttggttctggaattacgctcaagggcaaggtgacaatcaccgccaagtctggagtgaagttggaggttccagatggagctgtatatgaaaacaaggatgtcaatg

SEQ ID NO: 1403 - DNA, 270 bp, Zea mays
gtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttgctcggttcaagtccatccccagcatagttgag

SEQ ID NO: 1404 - DNA, 270 bp, Zea mays
ggaggttactccaaagacgctggctgacgttaagggtggcactctcatctcttacgaaggaagagttcagcttttggagattgcccaagtacccgatgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgc

SEQ ID NO: 1405 - DNA, 263 bp, Zea mays
tgatgacacacagaagattgttgagaagtattccaactccaacatcgaaattcatactttcaatcagagccagtatcctcgcattgttaccgaggacttcttgccacttcccagcaaagggaaatctgggaaggatggctggtatcctcctggtcatggtgatgtgtttccttctttgaataacagcggaaaacttgacatcttattggctcagggcaaggagtatgtctttgttgcaaactcagacaacttgggtgctatag

SEQ ID NO: 1406 - DNA, 263 bp, Zea mays
gcaaggagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggagattgcccaagtacccgatgagcatgtgaatgaatttaaatcaatcgagaagtttaagatattcaacactaacaacttgtgggtg

SEQ ID NO: 1407 - DNA, 273 bp, Zea mays
aagaagtattccaactccaacatcgaaattcatactttcaatcagagccagtatcctcgcattgttaccgaggacttcttgccacttcccagcaaagggaaatctgggaaggatggctggtatcctcctggtcatggtgatgtgtttccctctttgaataacagcggaaaacttgacatcttattggctcagggcaaagagtatgtctttgttgcaaactcagacaactggggtgctatagtcgacatcaagatcctaaaccatctgatcaat

SEQ ID NO: 1408 - DNA, 271 bp, Zea mays
  unsure (1)..(271): unsure at all n locations
ccgcaatgggttcacattccttgaccttattgtgattcaaattgagtccctgaacaagaagtaggatgcaagtcctttacttctgatgaactctttcaacacccatgatgacacacagaagattgttgagaagtattccaactccaacatcgaaattcatactttcaatcagagccagtatcctcgcattgttaccgaggacttcttgccacttcccagcaaagggaaatctgnggaggatggctggtatcctcctggtcatggtgatgtg

SEQ ID NO: 1409 - DNA, 227 bp, Zea mays
aagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgat

SEQ ID NO: 1410 - DNA, 273 bp, Zea mays
aaaggcggtactctcatctcttacgaaggaagagttcagcttttggagattgcccaagtacctgatgagcatgtgaatgagtttaaatcaatcgagaagtttaagatattcaacactaacaacttgtgggtgaaccttaaagctgtcaagagactagtagaggctgaggcacttaagatggaaattattccaaaccccaaggaagttgatggtgtgaaagtccttcaacttgaaactgcagctggtgcagctattcgtttctttgacaaagcg

SEQ ID NO: 1411 - DNA, 255 bp, Zea mays
gcggacagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattcaaattgagtccctgaacaagaagtatg

SEQ ID NO: 1412 - DNA, 259 bp, Zea mays
agggcaaggagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggagattgcccaagtacccgatgagcatgtgaatgaatttaaatcaatcgagaagtttaagatattcaacactaacaactt

SEQ ID NO: 1413 - DNA, 265 bp, Zea mays
tcctcgcattgttaccgaggacttcttgccacttcccagcaaagggaaatctgggaaggatggctggtatcctcctggtcatggtgatgtgtttccctctttgaataacagcggaaaacttgacatcttattggctcagggcaaagagtatgtctttgttgcaaactcagacaacttgggtgctatagtcgacatcaagatcctaaaccatctgatcaataaccagaacgagtactgcatggaggttactccaaagacgctggct

SEQ ID NO: 1414 - DNA, 278 bp, Zea mays
caagtacccgatgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccgcgctcaaggtttctcccagtgaaggctacatctgatctgtt

SEQ ID NO: 1415 - DNA, 269 bp, Zea mays
gggaaatctgggaaggatggctggtatcctcctggtcatggtgatgtgtttccttctttgaataacagcggaaaacttgacatcttattggctcagggcaaggagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagct

SEQ ID NO: 1416 - DNA, 293 bp, Zea mays
aagctatcaagagactcgtagaggctgaggcacttaagatggaaattattccaaaccccaaggaagttgatggtgtgaaagtccttcaactcgtaaccgcagctggtgcagctattcggttcttcgactaagcgattggaataatgttccccgcacatagaatctcccagtgaaggctacatctgatctgttgcttgtgcagtctgatctttacaccttggttgatggctttgtcatccgcaacccatccagagcgaatccagctaacccttcaattgagcttggacctgagt

SEQ ID NO: 1417 - DNA, 329 bp, Zea mays
ccgcaatccatccagagcgaatccagctaacccttcgattgagcttggacctgagttcaagaaggttgccaatttccttgctcggttcaagtccatccccagcatcgtcgagcttgacagcttgaaggtttctggtgatgtctggtttggttctggaattacgctcaagggcaaggtgacaatcaccgccaagtctggagtgaagttggaggttccagatggagctgtatttgaaaacaaggatgtcaatggccctgaggatctttaagctagcttgccgtcaccagtttttcccaaggatttgtcaataggagcagccaacccaaatc

SEQ ID NO: 1418 - DNA, 262 bp, Zea mays
gtgaaagtccttcaacttgaaactgcagctggtgcagctattcgtttctttgacaaagcgattggaattaatgttccccgctcaagatttctcccggtgaaggctacatctgatttattgcttgtgcagtctgatctttacaccttggttgatggctttgtcatccgcaatccatccagagcgaatccagctaacccttcgattgagcttggacctgagttcaagaaggttgccaatttccttgctcggttcaagtccatcc

SEQ ID NO: 1419 - DNA, 259 bp, Zea mays
gttaagggtggcactctcatctcttacgaaggaagagttcagcttttggagattgcccaagtacccgatgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattc

SEQ ID NO: 1420 - DNA, 252 bp, Zea mays
ctttacaccttggttgatggctttgtcatccgcaacccatccagagcgaatccagctaacccttcaattgagcttggacctgagttcaagaaggttgccaatttccttgctcggttcaagtccatccccagcatagttgagcttgacagcttgaaggtttctggtgatgtctggtttggctctggaattacactcaagggcaaggtgacaattatcgccaagcctggagtgaagttggagattccagatgga

SEQ ID NO: 1421 - DNA, 302 bp, Zea mays
cgtttcgaagcctcgcgagccccgacgatggccaccaccgcggtgtcggtcgacgagaagctcgataagcttcgcgccgaggtcgccaagctcgaccagatcagcgagaacgagaagtccgggttcatcagcctcgtgtcacggtacctcagtggggaggcggacagatcgagtggagcaagatccagacccctacggatgacgtggtggtgccctacgataccgtcgcgtcgcctcccgaagatctcgaggagacgaagaagctgctggataagctcgttgtgctcaagcttaacggaggg

SEQ ID NO: 1422 - DNA, 249 bp, Zea mays
cggctcgagtcaaagggtatctgggctctggttgaaagtatgaatttcgatgttggagttggaatacttctcaacaatcttctgtgtgtcatcatgggtgttgaaagagttcatcagaagtaaagggacattgcatccatacttcttgttcagggactcaatttgaatcacaataaggtcaaggaatgtgaacccattgcggacttcaatgacagacttgggcccagtgcagcccatggtcgtcccgag

SEQ ID NO: 1423 - DNA, 283 bp, Zea mays
ccttaagatattcaagactaacaacttgtgggtgaaccttaaagctatcaagagactcgtagacgctgaggcacttaagatggcgattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacagcttggttgatggctttgtcatccgc

SEQ ID NO: 1424 - DNA, 270 bp, Zea mays
agcgaatccagctaacccttcaattgagcttggacctgagttcaagaaggttgccaatttccttgctcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggatgtcaatggccctgaggatctttaagcaatgtttgtcatcac

SEQ ID NO: 1425 - DNA, 258 bp, Zea mays
tggagattgcccaagtacctgatgagcatgtgaatgagtttaaatcaatcgagaagtttaagatattcaacactaacaacttgtgggtgaaccttaaagctgtcaagagactagtagaggctgaggcacttaagatggaaattattccaaaccccaaggaagttgatggtgtgaaagtccttcaacttgaaactgcagctggtgcagctattcgtttctttgacaaagcgattggagttaatgttccccgctcaagat

SEQ ID NO: 1426 - DNA, 307 bp, Zea mays
gcagcttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggagctgagttcaag

SEQ ID NO: 1427 - DNA, 230 bp, Zea mays
ctacatctgatctgttgcttgtgcagtctgatctttacaccttggttgatggctttgtcatccgcaacccatccagagcgaatccagctaacccttcaattgagcttggacctgagttcaagaaggttgccaatttccttgctcggttcaagtccatccccagcatagttgagcttgacagcttgaaggtttctggtgatgtctggtttggctctggaattacactcaag

SEQ ID NO: 1428 - DNA, 271 bp, Zea mays
ggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaag

SEQ ID NO: 1429 - DNA, 243 bp, Zea mays
cccacgcgtccggtgtttccttcgttgaataacagcggaaaacttgacatcttattggctcagggcaaggagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggag

SEQ ID NO: 1430 - DNA, 317 bp, Zea mays
ggcacacacaccacaccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggagcagatcgagtggagcaagatccagacccctacggatgaggtggtggtgccctacgataccgtcgcgtcgcctcccgaagatctcga

SEQ ID NO: 1431 - DNA, 242 bp, Zea mays
cttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttgctcggttcaagtccatccccagcatagttgagcttgacagcttga

SEQ ID NO: 1432 - DNA, 214 bp, Zea mays
aaggacttcttgccacttccaagcaaagggaaatctgggaaggatggctggtatcctccaggccatggtgatgtgttcccctctttgaataacagtggaaaactcgacatcttattggctcagggcaaggagtatgtcttcgttgctaactcagacaacttgggtgctatagtcgacatcaagatcctgaaccatctgatcaataaccagaatg

SEQ ID NO: 1433 - DNA, 318 bp, Zea mays
aggcagacggcacacacaccacaccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggacagatcgagtggagcaagatccagacccctacggatgaggtggtggtgccctacgataccgtcgcgtcgcctcccgaaga

SEQ ID NO: 1434 - DNA, 234 bp, Zea mays
gcacgaggggaaatctgggaaggatggctggtatcctcctggtcatggtgatgtgtttccttctttgaataacagcggaaaacttgacatcttattggctcagggcaaggagtatgtctttgttgcaaactcagacaacttgggtgctatagtcgacatcaagatcctaaaccatctgatcaataaccagaacgagtactgcatggaggttactccaaagacgctggctgacgt

SEQ ID NO: 1435 - DNA, 255 bp, Zea mays
cggtactctcatctcttacgaaggaagagttcagcttttggagattgcccaagtacctgatgagcatgtgaatgagtttaaatcaatcgagaagtttaagatattcaacactaacaacttgtgggtgaaccttaaagctgtcaagagactagtagaggctgaggcacttaagatggaaattattccaaaccccaaggaagttgatggtgtgaaagtccttcaacttgaaactgcagctggtgcagctattcgttt

SEQ ID NO: 1436 - DNA, 302 bp, Zea mays
cacaccacaccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggagcagatcgagtggagcaagatccagacccctacggatgaggtggtggtgccctacgataccgtcgcgtcgcctcccga

SEQ ID NO: 1437 - DNA, 312 bp, Zea mays
cacaccacacctcctcgcttgcactccgctcgtctgacatctcgtcccgtcctttcgtttcgaagcctcgcgagccccgacgatggccaccaccgcggtgtcggtcgacgagaagctcgataagcttcgcgccgaggtcgccaagctcgaccagatcagcgagaacgagaagtccgggttcatcagcctcgtgtcacggtacctcagtggggaggcggacagatcgagtggagcaagatccagacccctacggatgaggtggtggtgccctacgataccatcgcgtcgcctccgaagatctcgaggagacga

SEQ ID NO: 1438 - DNA, 225 bp, Zea mays
gcacgaggggaaatctgggaaggatggctggtatcctcctggtcatggtgatgtgtttccttctttgaataacagcggaaaacttgacatcttattggctcagggcaaggagtatgtctttgttgcaaactcagacaacttgggtgctatagtcgacatcaagatcctaaaccatctgatcaataaccagaacgagtactgcatggaggttactccaaagacgct

SEQ ID NO: 1439 - DNA, 230 bp, Zea mays
cccacgcgtccgggctggtatcctcctggtcatggtgatgtgtttccttctttgaataacagcggaaaacttgacatcttattggctcatggcaaggagtatgtctttgttgcaaactcagacaacttgggtgctatagtcgacatcaagatcctaaaccatctgatcaataaccagaacgagtactgcatggaggttactccaaagacgctggctgacgttaagggtgg

SEQ ID NO: 1440 - DNA, 309 bp, Zea mays
cacacaccacaccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggacagatcgagtggagcaagatccagacccctacggatgaggtggtggtgcctacgataccgtcagcgtcgctccgaagatctcg

SEQ ID NO: 1441 - DNA, 254 bp, Zea mays
agtacttcaacttgaaactgcagctggtgcagctattcgtttctttgacaaagcgattggaattaatgttccccgctcaagatttctcccggtgaaggctacatctgatttattgcttgtgcagtctgatctttacaccttggttgatggctttgtcatccgcaatccatccagagcgaatccagctaacccttcgattgagcttggacctgagttcaagaaggttgccaatttccttgctcggttcaagtcca

SEQ ID NO: 1442 - DNA, 307 bp, Zea mays
acacacaccacaccacacctcctcgcttgcactccgctcgtctgacatctcgtcccgtcctttcgtttcgaagcctcgcgagccccgacgatggccaccaccgcggtgtcggtcgacgagaagctcgataagcttcgcgccgaggtcgccaagctcgaccagatcagcgagaacgagaagtccgggttcatcagcctcgtgtcacggtacctcagtggggaggcggagcagatcgagtggagcaagatccagacccctacggatgaggtggtggtgccctacgataccgtcgcgtcgcctcccgaaa

SEQ ID NO: 1443 - DNA, 203 bp, Zea mays
gaacaagaagtatggatgcaatgtccctttacttctgatgaactctttcaacacccatgatgacacacagaagattgttgagaagtattccaactccaacatcgaatttcatactttcaatcagagccagtatcctcgcattgttaccgaggacttcttgccacttcccagcaaagggaaatctgggaaggatggctggtatc

SEQ ID NO: 1444 - DNA, 287 bp, Zea mays
gagttcaagaaggttgccaatttccttggtcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggatgtcaatggccctgaggatctttaagcaatgtttatcatcaccagttttcccaaggacatgtcacaggaactgccaagcctaatcactcctactga

SEQ ID NO: 1445 - DNA, 239 bp, Zea mays
cccacgcgtccgcccacgcgtccgacaacttgtgggtgaaccttaaagctgtcaagagactagtagaggctgaggcacttaagatggaaattattccaaaccccaaggaagttgatggtgtgaaagtccttcaacttgaaactgcagctggtgcagctattcgtttctttgacaaagcgattggaattaatgttccccgctcaagatttctcccggtgaaggctacatctgatttattg

SEQ ID NO: 1446 - DNA, 269 bp, Zea mays
cagcgcgcgtacgtgagcgcgcggttgggctcgagcgaccttagagctatcaagagagtcgtagagggctgaggcacttgagcatggagattgttccagaccccaagggagttgatggtgtgagagtccttcaactcgaaaccgcagctggtgcagctattcggttcttcgacaaagcgattggaattaatgttccccgctcaaggtttctcccagtgaaggctacatctggtctgttgcttgtgcagtctggtctttacagcttggtt

SEQ ID NO: 1447 - DNA, 224 bp, Zea mays
cggaccgtgggccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctga

SEQ ID NO: 1448 - DNA, 273 bp, Zea mays
agaaggttgccaatttccttgctcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggatgtcaatggccctgaggatctttaagcaatgtttgtcatcaccagtttttcccaaggacatgtcacaggaactgccaagcctagtcact

SEQ ID NO: 1449 - DNA, 293 bp, Zea mays
gaaggttgccaatttccttgctcggttcaagtccatccccagcatcgtcgagcttgacagcttgaaggtttctggtgatgtctggtttggttctggaattacgctcaagggcaaggtgacaatcaccgccaagtctggagtgaagttggagattccagacggagctgtatttgaaaacaaggatgtcaatggccctgaggatctttaagctatgcttgccgtcaccagtttttcccaaggacatgtcaataggagctgccaacccaaatcactcccgctgagctctacctttt

SEQ ID NO: 1450 - DNA, 311 bp, Zea mays
caccacacctcctcgcttgcactccgctcgtctgacatctcgtcacgtcctttcgtttcgaagcctcgcgagccccgacgatggccaccaccgcggtgtcggtcgacgagaagctcgataagcttcgcgccgaggtcgccaagctcgaccagatcagcgagaacgagaagtccgggttcatcagcctcgtgtcacggtacctcagtggggaggcggacagatcgagtggagcaagatccagacccctacggatgaggtggtggtgccctacgataccgtcgcgtacgctcccgaagatctcgaggagacga

SEQ ID NO: 1451 - DNA, 277 bp, Zea mays
cacaccacacctcctcgcttgcactccgctcgtctgacatctcgtcccgtcctttcgtttcgaagcctcgcgagccccgacgatggccaccaccgcggtgtcggtcgacgagaagctcgataagcttcgcgccgaggtcgccaagctcgaccagatcagcgagaacgagaagtccgggttcatcagcctcgtgtcacggtacctcagtggggaggcggacagatcgagtggagcaagatccagacccctacggatgaggtggtggtgccctacgata

SEQ ID NO: 1452 - DNA, 220 bp, Zea mays
ccaagtacctgatgagcatgtgaatgagtttaaatcaatcgagaagtttaagatattcaacactaacaacttgtgggtgaaccttaaagctgtcaagagactagtagaggctgaggcacttaagatggaaattattccaaaccccaaggaagttgatggtgtgaaagtccttcaatttgaaactgcagctggtgcagctattggtttcttagacaaagcg

SEQ ID NO: 1453 - DNA, 199 bp, Zea mays
gcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattcctggacct

SEQ ID NO: 1454 - DNA, 259 bp, Zea mays
aagttgccaatttccttgctcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggatgtcaatggccctgaggatctttaagcaatgtttgtcatcaccagtttttcccaaggacatgtcacaggaactgccga

SEQ ID NO: 1455 - DNA, 294 bp, Zea mays
cacacctcctcgcttgcactccgctcgtctgacatctcgtcccgtcctttcgtttcgaagcctcgcgagccccgacgatggccaccaccgcggtgtcggtcgacgagaagctcgataagcttcgcgccgaggtcgccaagctcgaccagatcagcgagaacgagaagtccgggttcatcagcctcgtgtcacggtacctcagtggggaggcggacagatcgagtggagcaagatccagacccctacggatgacgtggtggtgccctacgataccgtcgcgtcgcctcccgaaga

SEQ ID NO: 1456 - DNA, 307 bp, Zea mays
accacacaacctcgcttccacaccgctcgtctgacatatcgtcccgtcctttcgtttcgaagcctcgcgagcaccgacgatagccaccgccgcggtgtcggtcgacgagaagctcgacaagcttcgcgccgaggtcgccaagctcgaccagatcagcgagaacgagaagaccgggttcatcagcctcgtgtcacgctacctcagtagggaagcggagcagatcgagtggagcaagatccagacacctacggatgaggtggtggtgccctacgataccgtcgcgtcgcctcccgaagatctcgaggag

SEQ ID NO: 1457 - DNA, 270 bp, Zea mays
cggacgctgggttctgaggctcgcgaaccccgacgatggccgccaccgcggtgtcggtcgacgagaagctcgacaagcttcgcgccgaggtcgccaaactcaaccagatcagcgagaacgagaagtccgggttcatcagcctcgtgtcacgttacctcagtggggaggcggacagatcgagtggagcaagatccagaccccgaccgatgaggtggtggtgccgtacgatatcctcgcgtcacctactgaagatctcgaggagacgaagaa

SEQ ID NO: 1458 - DNA, 265 bp, Zea mays
cagcccctcctcgctcgcactccgctcgactgacatctcctcccgtcctttcgtttctgaggctcgcgaaccccgacgatggccgccaccgcggtgtcggtcgacgagaagctcgacaagcttcgcgccgaggtcgccaaactcaaccagatcagcgagaacgagaagtccgggttcatcagcctcgtgtcacgttacctcagtggggaggcggagcagatcgagtggagctagatccagaccccgaccgcatgagtggtggtgc

SEQ ID NO: 1459 - DNA, 307 bp, Zea mays
ggacctgggcggcagacggcacacacaccacaccacacctcctcgcttccactccgctcgactgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggacagatcgagtggagcaagatccagacccctacggatgaggtggtggtgccctacgatacc

SEQ ID NO: 1460 - DNA, 259 bp, Zea mays
cccacgcgtccgcctcctcgcttgcactccgctcgtctgacatctcgtcccgtcctttcgtttcgacgcctcgcgagccccgacgatggccaccaccgcggtgtcggtcgacgagaagctcgataagcttcgcgccgaggtcgccaagctcgaccagatcagcgagaacgagaagtccgggttcatcagcctcgtgtcacggtacctcagtggggaggcggacagatcgagtggagcaaatccagaccctacggatgag

SEQ ID NO: 1461 - DNA, 314 bp, Zea mays
accacaccacacctcctcgcttgcactccgctcgtctgacatctcgtcccgtcctttcgtttcgaagcctcgcgagccccgacgatggccaccaccgcggtgtcggtcgacgagaagctcgataagcttcgcgccgaggtcgccaagctcgaccagatcagcgagaacgagaagtccgggttcatcagcctcgtgtcacggtacctcagtggggaggcggacagatcgagtggagcaagatccagacccctacggatgaggtggtggtgccctacgataccgtcgcgtcgcctcccgaagatctcgaggagacg

SEQ ID NO: 1462 - DNA, 238 bp, Zea mays
  unsure (1)..(238): unsure at all n locations
gttcgtctgacatctcctcccgtcctttcctttctgaggctcgcgaaccccgacaatggccgcaaccgcggtgtcggtcgacgagaagctcgacaagcttcgcgccgaggtcgccaaactcagccagatcagcgagaacgagaaggccgggttcatcagcctcgtgtcacgctacctcagtggggaggcgganagatcgagtggagcaagatccagaccccgaccgatgaggtagtgg

SEQ ID NO: 1463 - DNA, 289 bp, Zea mays
acacaccacaccacacctcctcgcttgcactccgctcgtctgacatctcgtcccgtcctttcgtttcgaagcctcgcgagcaccgacgatggccaccaccgcggtgtcggtcgacgagaagctcgataagcttcgcgccgaggtcgccaagctcgaccagatcagcgagaacgacaactccgggttcatcagcctcgtgtcacggtacctcagtggggaggcggacagatcgagtggagcaagatccagacccctaaggatgaggtggtggtgccctacgataccgtcg

SEQ ID NO: 1464 - DNA, 299 bp, Zea mays
gcagtctaacagcaccccctcctcgctcgcactccgttcgtctgaactctcctcccgtcctttcctttctgaggctcgcgaaccccgacaatggccgcaaccgcggtgtcggtcgacgagaagctcgacaagcttcgcgccgaggtcgccaaactcagccagatcagcgagaacgagaaggccgggttcatcagcctcgtgtcacgctacctcagtggggaggcggacagatcgagtggagcaagatccagaccccgaccgatgaggtagtggtgccgtacgataccctcacgtcgcct

SEQ ID NO: 1465 - DNA, 257 bp, Zea mays
gcaccccctcctcgctcgcactccgctcgtctgacatctcctcccgtcctttcctttctgaggctcgcgaaccccgacgatggccgccaccgcggtgtcggtcgacgagaagctcgacaagcttcgcgccgaggtcgccaaactcaaccagatcagcgagaacgagaagtccgggttcatcagcctcgtgtcacgttacctcagtggggaggcggacagatcgagtggagcaagatccagaccccgaccgatgaggt

SEQ ID NO: 1466 - DNA, 188 bp, Zea mays
ggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccat

SEQ ID NO: 1467 - DNA, 289 bp, Zea mays
cggcacacacaccacaccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggacagatcgagtggagcaagatccagacccctacggatgaggtggtggtgcctacgatac

SEQ ID NO: 1468 - DNA, 275 bp, Zea mays
acacggcacacacaccacaccacacctcctcgcttccactccgctcgtctgacatctcgtcccgtcctttcctttcgaagcctcgcgagccccgacgatggccaccgccgcggtgtcggtcgacgagaagctcgacaagcttcgcgccgaggtcgccaagctcgaccagatcagcgagaacgagacgtccgggttcatcagcctcgtgtcccgctacctcagtggggaagcggacagatcgagtggagcaagatccagacccctacggatgaggt

SEQ ID NO: 1469 - DNA, 315 bp, Zea mays
accacaccacacctcctcgcttgcacaccgctcgtctgacatctcgtcccgtcctttcgtttcgaagcctcgcgagcaccgacgatagccaccaccgcggtgtcggtcgacgagaagctcgataagcttcgcgccgaggtcgccaagctcgaccagatcagcgagaacgagaagaccgggttcatcagcctcgtgtcacggtacctcagtacggaggcggagcagatcgagtagagcaagatccagactcctacggatgaggtggtggtaccctacgatacagtcgcgtcgcctcccgaagatctcgaggagacg

SEQ ID NO: 1470 - DNA, 250 bp, Zea mays
aggcacacacaccacaccacacctcctcgcttccacaccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggacagatcgagtggagaagat

SEQ ID NO: 1471 - DNA, 255 bp, Zea mays
cacacacaccacaccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggacagatcgagtggagcaagatccagacc

SEQ ID NO: 1472 - DNA, 276 bp, Zea mays
atacggcacacacaccacaccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggacagatcgagtggagcaagatccagacccctacggatgaggtg

SEQ ID NO: 1473 - DNA, 256 bp, Zea mays
ctccccctcctcgctcgcactccgctcgtctgacatctcctcccgtcctttcctttctgaggctcgcgaaccccgacgatggccgccaccgcggtgtcggtcgacgagaagctcgacaagcttcgcgccgaggtcgccaaactcaaccagatcagcgagaacgagaagtccgggttcatcagcctcgtgtcacgttacctcagtggggagacggagcagatcgagtgagaccagatccagaccccgacggataagg

SEQ ID NO: 1474 - DNA, 258 bp, Zea mays
cggacgcgtggcggacgcgtgggcggacgcgtgggcggacgcgtgggcagcggaaaacttgacatcttataggctcagggcaatgagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggag

SEQ ID NO: 1475 - DNA, 292 bp, Zea mays
cacacacaccacaccacacctcctcgcttccactccgctcgtctgacatctcgtcgcgtcctttcgtttcgaagcctcgcgagccccgacgatggccaccgccgcggtgtcggtcgacgagaagctcgacaagctcgcgccgaggtcgccaagctcgaccagagtagcgagaacgagaagtccgggttcatcagcctcgtgtcacgctacctcagtggggaagcggacagatcgagtggagcaagatccagaccctacggatgaggtggtggtgcctacgataccgtcgcgt

SEQ ID NO: 1476 - DNA, 308 bp, Zea mays
cactcgagcgaattcggctcgaggtccatccccagcatagatgagcttgacagctacaaccgttctggtgatgtatggattggctctggaattacactcaagggcaaggtgacaattatcgccaagcctggagtgaagttggagattccagatggagacgtacttgagaacaaggatgtcaatggccctgaggatctttaagcaatgtttgtcatcaccagtttttcccaaggacatgtcacaggaactgccaagcctagtcactcctactgagctctatattttgtaattttcatgtgcattccgat

SEQ ID NO: 1477 - DNA, 189 bp, Zea mays
agcttgaaggtttctggtgatgtctggtttggttctggaattacgctcaagggcaaggtgacaatcaccgccaagtctggagtgaagttggagattccagacggagctgtatttgaaaacaaggatgtcaatggccctgaggatctttaagctatgcttgccgtcaccagtttttcccaaggacatgtc

SEQ ID NO: 1478 - DNA, 158 bp, Zea mays
tgaagtttaagatattcaacactaacaacttgtgggtgaaccttaaagctgtcaagagactagtagaggctgaggcacttaagatggaaattattccaaaccccaaggaagttgatggtgtgaaagtccgtcaacttgaaactgcagctggtgcagct

SEQ ID NO: 1479 - DNA, 245 bp, Zea mays
cccacgcgtccgcccacgcgtccgacacaccacaccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaag

SEQ ID NO: 1480 - DNA, 271 bp, Zea mays
agcttgaaggtttctggtgatgtctggtttggttctggaattacgctcaagggcaaggtgacaatcaccgccaagtctggagtgaagttggagattccagacggaactgtatttgaaaacaaggatgtcaatggccctgaggatctttaagctatgcttgccgtcaccagtttttcccaaggacatgtcaataggagctgccaacccaaatcactcccgctgagctctaccttttgtaattctcgtgccgttccgcttccgctgtgagggt

SEQ ID NO: 1481 - DNA, 247 bp, Zea mays
cgcttgaaggtttctggtgatgtctggtttggttctggaattacgctcaagggcaaggtgacaatcaccgccaagtctggagtgaagttggagattccagacggagctgtatttgaaaacaaggatgtcaatggccctgaggatctttaagctatgcttgccgtcaccagtttttcccaaggacatgtcaataggagctgccaacccaaatcactcccgctgagctctaccttttgtaattctcgtg

SEQ ID NO: 1482 - DNA, 225 bp, Zea mays
acacaccacaccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcgga

SEQ ID NO: 1483 - DNA, 256 bp, Zea mays
cggcacacacaccacaccacacctcctcgcttccactccgctcgtctgacatctcgtcccgtcctttcctttcgaagcctcgcgagccccgacgatggccaccgccgcggtgtcggtcgacgagaagctcgacaagcacccgccgaggtcgccaagctcgaccagatcagcgagaacgagaagtccgggttcatcagcctcgtgtcacgctacctcagtggggaagcggacagatcgagtggagcaagatccgacc

SEQ ID NO: 1484 - DNA, 237 bp, Zea mays
gcgggcagtctaacagcaccccctcctcgctcgcactccgttcgtctgacatctcctcccgtcctttcctttctgaggctcgcgaaccccgacaatggccgcaaccgcggtgtcggtcgacgagaagctcgacaagcttcgcgccgaggtcgccaaactcagccagatcagcgagaacgagaaggccgggttcatcagcctcgtgtcacgctacctcagtgggggagcgggacagat

SEQ ID NO: 1485 - DNA, 223 bp, Zea mays
cacctcctcgcttgcactccgctcgtctgacatctcgtcccgtcctttcgtttcgaagcctcgcgagccccgacgatggccaccaccgcggtgtcggtcgacgagaagctcgataagcttcgcgccgaggtcgccaagctcgaccagatcagcgagaacgagaagtccgggttcatcagcctcgtgtcacggtacctcagtggggaggcggacagatcgagtg

SEQ ID NO: 1486 - DNA, 141 bp, Zea mays
agctgaggcacttaagatggaaattattccaaacccaaggaagttgatggtgtgaaagtccttcaacttgaaactgcagctggtgcagctattcgtttctttgacaaagcgattggaattaatgttccccgctcaagattt

SEQ ID NO: 1487 - DNA, 257 bp, Zea mays
cggcacacacaccacaccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggacagatcgagtggagcaagatccagac

SEQ ID NO: 1488 - DNA, 143 bp, Zea mays
tggtgatgtctggtttggctctggaattacactcaagggcaaggtgacaattatcgccaagcctggagtgaagttggagattccagatggagacgtacttgagaacaaggatgtcaatggccctgaggatctttaagcaatgt

SEQ ID NO: 1489 - DNA, 200 bp, Zea mays
ccacaccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgc

SEQ ID NO: 1490 - DNA, 272 bp, Zea mays
agacggcacacacaccacaccacacctcctcgcttccactccgctcgtctgatctctcgtcccgtcctttcgtttcgaagcctcgcgagccccgacgatggccaccgccgcggtgtcgatcgacgagaagctcgacaagcttcgcgccgaggtcgccaagctcgaccagatcagcgagaacgagaagtccgggttcatcagcctcgtgtcacgctacctcagtggggaagcggacagatcgagtggagcaagatccagacccctacggatga

SEQ ID NO: 1491 - DNA, 149 bp, Zea mays
ctttgttgcaaactcagacaacttgggtgctatagtcgacaacaagatcctaaaccatctgatcaataaccagaacgagtattgcatggaggttactccaaagacgctggctgacgttaagggtggcactctcatctcttacgaaggaa

SEQ ID NO: 1492 - DNA, 189 bp, Zea mays
atcgcgtcctttcctttctgaggctcgcgaaccccgacaatggccgcaaccgcggtgtcggtcgacgagaagctcgacaagcttcgcgccgaggtcgccaaactcagccagatcagcgagaacgagaaggccgggttcatcagcctcgtgtcacgctacctcagtggggaggcggacagatcgagtgga

SEQ ID NO: 1493 - DNA, 295 bp, Zea mays
caccacaccacacctcctcgcttgcactccgctcgtctgacatctcgtcccgtcctttcgtttcgaagcctcgcgagccccgacgattgccaccaccgcggtgtcggtcgacgagaagctcgatgagcttcgcgccgaggtcgccaagctcgaccagatcagcgagaacgagaagtccgggttcatcagcctcgtgtcacggtacctcagtggggaggcggacagatcgagtggagcaagatccagacccctacggatgaggtggtggtgcgctacgataccgtcgcgtcgcctc

SEQ ID NO: 1494 - DNA, 253 bp, Zea mays
ctggtttggctctggaattacactcaagggcaaggtgacaattatcgccaagcctggagtgaagttggagattccagatggagacgtacttgagaacaaggatgtcaatggccctgaggatctttaagcaatgtttatcatcaccagttttcccaaggacatgtcacaggaactgccaagcctaatcactcctactgagctctatattttgtaattttcatgtgcattccgattccgctgtgagggtcatgtg

SEQ ID NO: 1495 - DNA, 286 bp, Zea mays
acgccccgaccacggtccgcgacgctgggcgaccgtggcggcagacggcacacacaccacaccacacctcctcgcttccactcacgctcgtctaccatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggacagatcgag

SEQ ID NO: 1496 - DNA, 116 bp, Zea mays
gtggtgccctacgataccgtcgcgtcgcctcccgaagatctcgaggagacgaagaagctgctggataagctcgttgtgctcaagcttaacggagggctccggaacgaccatgggct

SEQ ID NO: 1497 - DNA, 237 bp, Zea mays
cggcagacggcacacacaccacaccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgatatctcagtggaaacgcgg

SEQ ID NO: 1498 - DNA, 150 bp, Zea mays
tttcgaagcctcgcgagcaccgacgatagccaccaacgcggtgtcggtcgacgagaagctcgataagcttcgcgccgaggtcgccaagctcgaccagatcagcgagaacgagaatttcgggttcatcagcctcgtgtcacggtacctcag

SEQ ID NO: 1499 - DNA, 116 bp, Zea mays
ctggtttggctctggaattacactcaatgggcaagtgacaattatcgccaagcctggagtgaagttggagattccagatggagacgtacttgagaacaaggatgtcaatggccctg

SEQ ID NO: 1500 - DNA, 99 bp, Zea mays
ggaccgtggcgagaagctcgataagcttcgcgccgaggtcgccaagctcgaccagatcagcgagaacgagaagtccgggttcatcagcctcgtgtcacg

SEQ ID NO: 1501 - DNA, 283 bp, Zea mays
gcgggacgggcggacggtgggcggaccgtggcggacggtgggtggccctgaggatctttaagcaatgagctgttctcaagtacgtctccatctggaatcgccaagcctggagtgaagttggagattccagatggagacgtacttgagaacaaggatgtcaatggccctgaggatctttaagcaatgtttgtcatcaccagtttttcccaaggacatgtcacaggaactgccaagcctagtcactcctactgagatctatattttgtaattttcatgtgcattc

SEQ ID NO: 1502 - DNA, 343 bp, Zea mays
gttcaagaaggttgggagcttccttggtcgcttcaagtcgatacctagcattgttgagcttgacagcttgaaggtttccggtgatgtttggttcggttctggaattgtactgaaggggaaagtgaccatcactgcaaaacctggcgtcaagctagaaatcccagacggagcagtgattgggaataaggatatcagtggccctgaggacctttagataagaatcagcgaatcagcaaggaggctcacttcgccaagtggcggatcatttttcgtgttttttttcctgtatattcaaacaggttccatgatattatggagaatattaattgccagtataatccag

SEQ ID NO: 1503 - DNA, 338 bp, Zea mays
cttactcggtcgcttcaagtcgatacctatcattgttgagcttgacagcttgaacgtctcgggtgatgtttggttcggttctggaattgcactgaatgggaaagcgtccatcactgcaaaacctgtcgtcaagctataaattcaatacggatcactgattggtgaataatgatctcagtcgccttgaggacctttagataagaataagcgtatcaccacgtacgcttacttacccaagtgacggatcatcgctcgtggactctcctgaatatccagacaagtccgatgatactacggaccatatcaactgccagcatattgcaatcattgtacatgta

SEQ ID NO: 1504 - DNA, 320 bp, Zea mays
cgcttcctaccagttaaggcgacatcagatttgcagctagtacagtctgatctatataccttggttgatggcttcgttacacgtaattcagccagaacaaatctatcaaatccctcaattgaacttggtcctgagttcaagaaggttgggagcttccttggtcgcttcaagtcgatacctagcattgttgagcttgacagcttgaaggtttccggtgatgtttggttcggttctggaattgtactgaaggggaaagtgaccatcactgcaaaacctggcgtcaagctagaaatcccagacggagcagtgattgggaataa

SEQ ID NO: 1505 - DNA, 425 bp, Zea mays
aaatcgagtccctgaacaagaagtatggatgtaatgtccctttacttctgatgaactctttcaatacccatgatgacacacagaagatcgttgagaagtattccaactccaacattgaaattcatactttcaatcagagccagtatcctcgcattgttaccgaggacttcttgccacttccaagcaaagggaaatctgggaaggatggctggtatcctccaggccatggtgatgtgttcccctctttgaataacagtggaaaactcgacatcttattggctcaaggcaaggagtatggtcttcgtgctaactcagacaacttgggtgctatagtcgacatcaagatcctgaaccatctgatcaataaccagaatgaatactgcatggaggttactccaaaaacattggctgatgttaaaggcggt

SEQ ID NO: 1506 - DNA, 414 bp, Zea mays
gggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttgctcggttcaagtccatccccagcatagttgagcttgacagcttgaaggtttctggtgatgtctggtttggctctggaattacac

SEQ ID NO: 1507 - DNA, 441 bp, Zea mays
cccacgcgtccggaggcacttaagatggaaattattccaaaccccaaggaagttgatggggtgaaagtccttcaacttgaaactgcagctggtgcagctattcgtttctttgacaaagcgattggaattaatgttccccgctcaagatttctcccggtgaaggctacatctgatttattgcttgtgcagtctgatctttacaccttggttgatggctttgtcatccgcaatccatccagagcgaatccagctaacccttcgattgagcttggacctgagttcaagaaggttgccaatttccttgctcggttcaagtccatccccagcatcgtcgagcttgacagcttgaaggtttctggtgatgtctggtttggttctggaattacgctcaagggcaaggtgacaatcaccgccaagtctggagtgaagttggaggttcca

SEQ ID NO: 1508 - DNA, 406 bp, Zea mays
ctcatctcttacgaaggaagagttcagcttttggagattgcccaagtacccggtgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattg

SEQ ID NO: 1509 - DNA, 412 bp, Zea mays
ctgacgttaagggtggcactctcatctcttacgaaggaagagttcagctgttggagagtgcccaagtacccgatgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagc

SEQ ID NO: 1510 - DNA, 436 bp, Zea mays
cccactcgtccgcccacgcgtccggggaggcggatcagatcgagtggagcaggatccagacccctactgatgaggtggtggtgccctactataccgtcgcgtcgcctcccgaagatctcgaggagactaagaagctgctggataagctcgttgtgctcaagcttaactgagggctcgggacgaccatgggctgcactgggcccaagtctgtcattgaagtccgcaatgggttcacattccttgaccttattgtgattcaaattgagtccctgaacaagaagtatggatgcaatgtccctttacttctgatgaactctttcaacacccatgatgacacacagaagattgttgagaagtattccaactccaacatcgaaattcatactttcaatcatagccagtatcctctcattgttaccgaggactttttgccact

SEQ ID NO: 1511 - DNA, 407 bp, Zea mays
  unsure (1)..(407): unsure at all n locations
accaagcgtccggcctcgtgtcacgctacctcagtggggaagcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattcaaattgagtccctgaacaagaagtatggatgcaatgtcnctttacttctgatgaactctttcaacacccatgatgacacacagaagattgttgagaagtattccaactccaacatcgaaattcatactttcaatcag

SEQ ID NO: 1512 - DNA, 440 bp, Zea mays
ggctggtatcctccaggccatggtgatgtgttcccctctttgaataacagtggaaaactcgacatcttattggctcagggcaaggagtatgtcttcgttgctaactcagacaacttgggtgctatagtcgacatcaagatcctgaaccatctgatcaataaccagaatgaatactgcatggaggttactccaaaaacattggctgatgttaaaggcggtactctcatctcttacgaaggaagagttcagcttttggagattgcccaagtacctgatgagcatgtgaatgagtttaaatcaatcgagaagtttaagatattcaacactaacaacttgtgggtgaaccttaaagctgtcaagagactagtagaggctgaggcacttaagatggaaattatttcaaaccccaaggaagttgatggtgtgaaagtccttcaact

SEQ ID NO: 1513 - DNA, 445 bp, Zea mays
gaagtattccaactccaacatcgaaattcatactttcaatcagagccagtagcctctcggtgttaccgaggacttcttgccacttcccagcaaagggaaatctgggaaggatggctggtatcctcctggtcatggtgatgtgtttccctctttgaataacagcggaaaacttgacatcttattggctcagggcaaggagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggagattgcccaagtatccgatgagcatgtgaatgaatttaaatcaatcgagaagtttaagatattcaacactaacaac

SEQ ID NO: 1514 - DNA, 477 bp, Zea mays
  unsure (1)..(477): unsure at all n locations
attcggttcttcgacaaagcgattggaattaatgttccccgctcaaggtttctcccagtggaggctacatctgatctgttgcttgtgcagtctgatctttacaccttggttgatggctttgtcatccgcaacccatccagagcgaatccagctaacccttcaattgagcttggacctgagttcaagaaggttgccaatttccttggtcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggatgtcaatggccctgaggatctttaagcaatgtttatcatcaccagttttcccaaggacatgtcacaggaactgccaagcctaatcactnctactgagctctatattttg

SEQ ID NO: 1515 - DNA, 450 bp, Zea mays
ggaaattattccaaaccccaaggaagttgttggtgtgaaagtccttcaacttgaaactgcagctggtgcagctattcgtttctttgacaaagcgattggaattaatgttccccgctcaagatttctcccggtgaaggctacatctgatttattgcttgtgcagtctgatctttacaccttggttgatggctttgtcatccgcaatccatccagagcgaatccagctaacccttcgattgagcttggacctgagttcaagaaggttgccaatttccttgctcggttcaagtccatccccagcatcgtcgagcttgacagcttgaaggtttctggtgatgtctggtttggttctggaattacgctcaagggcaaggtgacaatcaccgccaagtctggagtgaagttggaggttccagatggagcttgatttgaaaacaaggatgtcaatgg

SEQ ID NO: 1516 - DNA, 438 bp, Zea mays
cacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattc

SEQ ID NO: 1517 - DNA, 464 bp, Zea mays
  unsure (1)..(464): unsure at all n locations
gttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttggtcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggatgtcaatggccctgaggatctttaagcaatgtttatcatcaccagttttcccaaggacatgtcacaggaactgccaagcctaatcactcctactgagctctatattntgtaattttcatgtgcattccg

SEQ ID NO: 1518 - DNA, 421 bp, Zea mays
acccacgcgtccgctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgat

SEQ ID NO: 1519 - DNA, 443 bp, Zea mays
cccacgcgtccgccacaccacacctcctcgcttccactccgctcgtctgacatctcgtccggtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatggtctgcactgggcccaagtctgtcattgaagtccgcaatgggttcacattccttgac

SEQ ID NO: 1520 - DNA, 319 bp, Zea mays
atccttccggtaaacctcgccatctaattggctcatggcatggagtatgtcttcgttgctaactcggacagcttggttgctatagtcgacatcaagatcctgaaccatctgatcaataaccagaatgaatactgcatggaggttactccaaaaacattggctgatgttaaaggcggtactctcatctcttacgaaggaagagttcagcttttggagattgcccaagtacctgatgagcatgtgaatgagtttaaatcaatcgagaagtttaagatattcaacactaacaacttgtgggtgaacctttaagctgtcaaga

SEQ ID NO: 1521 - DNA, 394 bp, Zea mays
cccacgcgtccgcccacgcgtccgcccacgcgtccgcggacgcgtgggtttcaatcagagccagtatcctcgcattgttaccgaggacttcttgccacttcccagcaaagggaaatctgggaaggatggctggtatcctcctggtcatggtgatgtgtttccctctttgaataacagcggaaaacttgacatcttattggctcagggcaaagagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggagattgcccaa

SEQ ID NO: 1522 - DNA, 400 bp, Zea mays
cccacgcgtccggcccaagtacctgatgagcatgtgaatgagtttaaatcaatcgagaagtttaagatattcaacactaacaacttgtgggtgaaccttaaagctgtcaagagactagtagaggctgaggcacttaagatggaaattattccaaaccccaaggaagttgatggtgtgaaagtccttcaacttgaaactgcagctggtgcagctattcgtttctttgacaaagcgattggaattaatgttccccgctcaagatttctcccggtgaaggctacatctgatttattgcttgtgcagtctgatctttacaccttggttgatggctttgtcatccgcaatccatccagagcgaatccagctaacccttcgattgagcttggacctgagttcaaga

SEQ ID NO: 1523 - DNA, 419 bp, Zea mays
cacctcctcgcttgcactccgctcgtctgacatctcgtcccgtcctttcgtttcgaagggtcgggagccccgacgatggccaccaccgcggtgtcggtcgacgagaagctcgataagcttcgcgccgaggtcgccaagctcgaccagatcagcgagaacgagaagtccgggttcatcagcctcgtgtcacggtacctcagtggggaggcggagcagatcgagtggagcaagatccagacccctacggatgaagtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattcct

SEQ ID NO: 1524 - DNA, 408 bp, Zea mays
tgttacgcgttcaaggcatctcccagcgaaggctacatctgatctgctgcttgtgcaggctgatctttacaccgtggttgatggctttgtcatccgcaacccatgcagagcgaatccagctaacccttcaattgagcttggacctgagttcaagaaggttgccaatttacttggtcggttcaagtccatccccagcatagttgagcttgacagcttgaaggtttctggtgatgtctggtttggctctggaattacactcaagggcaaggtgacaattatcgccaagcctgtagtgaagttggagattccagatggagacgtacttgagaacaaggatgtcaatggtcctgaggatctataagcaatggttatcatcaccaggttttccaaggacatgttacagggact

SEQ ID NO: 1525 - DNA, 358 bp, Zea mays
ctcgcattgttaccgaggacttcttgccacttcccagcaaagggaaatctgggaaggatggctggtatcctcctggtcatggtgatgtgtttccttctttgaataacagcggaaaacttgacatcttattggctcagggcaaggagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggagattgcccaaagtccccgatgaagcatgtgaatggaattaaa

SEQ ID NO: 1526 - DNA, 349 bp, Zea mays
ccgtcctttcctttctgaggctcgcgaaccccgacaatggccgcaaccgcggtgtctgtcgacgagaagctcgacaagcttcgcgccgaggtcgccaaactcagccagatcagcgagaacgagaaggccgggttcatcagcctcgtgtcacgctacctcagtggggaggcggagcagatcgagtggagcaagatccagaccccgaccgatgaggtagtggtgccgtacgataccctcacgtcgcctcctgaagatctcgaggagacgaagaagctgctggacaagctcgttgtgctcaagctcaacggagggctcgggacgaccatgggctgcaccggacccaagtctg

SEQ ID NO: 1527 - DNA, 439 bp, Zea mays
  unsure (1)..(439): unsure at all n locations
cccacgcgtccgatgatctggtgctcgtgcaggctgatctttacaccttggatgatggctttgtcatccgcaacccatccagagcgaatccagctaacccttcaattgagcttggacctgagttcaagaaggttgccaatttccttggtcggttcaagtccatccccagcatagttgagcttgacagcttgaaggtttctggtgatgtctggtttggctctggaattacactcaagggcaaggtgacaattatcgtcaagcctggagtgaagttggagattccagatggagacgtacttgagaacaaggatgtcaatggccctgaggatctttaagcaatgtgtatcatcaccagttgtcccaaggacatgtcacatgaactgtcaagcctaatcactcctactgagctctatantttgtaatgttcatgtgcattccg

SEQ ID NO: 1528 - DNA, 373 bp, Zea mays
aattaatgttccccgctcaagatttctcccggtgaaggctacatctgatttattgcttgtgcagtctgatctttacaccttggttgatggctttgtcatccgcaatccatccagagcgaatccagctaacccttcgattgagcttggacctgagttcaagaaggttgccaatttccttgctcggttcaagtccatccccagcatcgtcgagcttgacagcttgaaggtttctggtgatgtctggtttggttctggaattacgctcaagggcaaggtgacaatcaccgtcaagtctggagtgaagttggaggttccagatggagctgtatttgaaaacaaggatgtcaatggccctgaggatccttaagctatg

SEQ ID NO: 1529 - DNA, 392 bp, Zea mays
caaattcatactttcaatcagagccagtatcctcgcattgttaccgaggacttcttgccacttcccagcaaagggaaatctgggaaggatggctggtatcctcctggtcatggtgatgtgtttccctctttgaataacagcggaaaacttgacatcttattggctcagggcaaagagtatgtctttgttgcaaactcagacaacttgggtgctatagtcgacatcaagatcctaaaccatctgatcaataaccagaacgagtactgcatggaagttactccaaagacgctggctgacgttaaaggtggcactctcatctcttacgaaaggaagagttcagctttttggagattgcccaagtacccgatgagcatgtgaatgaatttaaatca

SEQ ID NO: 1530 - DNA, 407 bp, Zea mays
cacaccacaccacacctgctcgcttccactccgctcgtctgacatctcgtcccgtcgttgcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggagcagatcgagtggagcaagatccagacccctacggatgaggtggtggtgccctacgataccgtcgcgtagcctcccgaagatctcgaggagacgaagaagctgctggataagctcgttgtgctcaagcttaacggagggctcgggacgaccatgggctgcactgggcccaagtatgtcattga

SEQ ID NO: 1531 - DNA, 407 bp, Zea mays
agcttttggagattgcccaagtacccgatgagcatgtatgttgctgtttctgtgtggcttaagtttcataatctgttccatgatttcaccaccagccttttgtagtaagagctacacaaccttttctaattttcttgtatctctatccaggtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaagtttctcccagtgaaggctacatctgatct

SEQ ID NO: 1532 - DNA, 460 bp, Zea mays
gtagctgcagtgcggtcgtagatcacgggtccacgcacgcgtccgaatggcattgtcatccgcaacccatccagagcgaatccagctaacccttcaattgagcttggacctgagttcaagaaggttgccaatttccttgctcggttcaagtccatccccagcatagttgagcttgacagcttgaaggtttctggtgatgtctggtttggctctggaattacactcaagggcaatgtgacaattatcgccaagcctggagtgaagttggagattccagatggagacgtacttgagaacaaggatgtcaatgggcctgaggatctttaagcaatgtctgtcatcaccagtttttcccaaggacatgtcacaggaactgccgagcctaatcactcctactgagctctatatttttgtaattttcatgtgcattccgattccgctgcgagggtcatgtgagccc

SEQ ID NO: 1533 - DNA, 257 bp, Zea mays
gtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccaatgaaggctacatctgatctgatgcttgtgcagtctgatctttaca

SEQ ID NO: 1534 - DNA, 378 bp, Zea mays
aacccacgcgtccgcccacgcgtccgcacacacaccacaccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcaggcgagtgcccccctcctctccgcactagatctcgccgcccgatcgcttcgcctcccatttttgctgatttctgagtgtgtttttccgcgcagcgagaacgagaagtccgggttcatcagcctcgtgtcacgctacctcagtggggaagcggagcagatcgagtggagcaagatccagaccccta

SEQ ID NO: 1535 - DNA, 60 bp, Zea mays
aatggaattaaaggtccccggttaagaattcttcccgtgaatgcttccttcgaattaatg

SEQ ID NO: 1536 - DNA, 342 bp, Zea mays
aagaattacactcaagggcaaggtgacaattatcgccaagcctggagtgaagttggagattccagatggagacgtacttgagaacaaggatgtcaatggccctgaggatctttaagcaatgtttgtcatcaccagtttttcccaaggacatgtcacaggaactgccaagcctagtcactcctactgagctctatattttgtaattttcatgtgcattccgattccgctgtgagggtcatgttaaccccgctagaaaataattgtaatcttctttgctgcgtctgtacttctgtttttggtcgccaggacgtatatttttactgaaatgatactccgaagagc

SEQ ID NO: 1537 - DNA, 443 bp, Zea mays
ctcaagggcaaggtgacaattatcgccaagcctggagtgaagttggagattccagatggagacgtacttgagaacaaggatgtcaatggccctgaggatctttaagcaatgtttatcatcaccagttttcccaaggacatgtcacaggaactgccaagcctaatcactcctactgagctctatattttgtaattttcatgtgcattccgattccgctgtgagggtcatgtgagcccgctagagaataattgtaatcttctttgctgcgtctgtacttctgtttttgtgcgccaggacgtatatttttactgaaatgatactccgtaatatattataatacttgttttatattatttttattgtttttattatattattatgttttttttatgtttttataatttattttttttttatattatttttttataatttttttattt

SEQ ID NO: 1538 - DNA, 229 bp, Glycine max
ggccgcacagcccgatgttgatggatttttggttggtggtgccaattctttgcagtttcctccatttacagaacctccatagataattcttacagatgcagcaactgcaaagaattggccgcacagcccgatgttgatgatttttggttggtggtgcctccctgaagccggagttcgtggacatcataaatgctgccactgtgaagaagaattgaaattcgtagttagg

SEQ ID NO: 1539 - DNA, 267 bp, Glycine max
  unsure (1)..(267): unsure at all n locations
ggnntngaggttgnacaagggtanctctgtctgcttctacaatttctctcgtnaccaatagaaanncaaaacnanaacatgggcagaaaattcttcgncggtggcaantgganattgaangggancaatgaggaggtaaagnagattgtnantactttgaatgaggctaaagtngctgnagangatgtngtagaagttgttgtgagaccnccttatgtgttccnnncatngnaanaagtttgctgcanctgnttnccatgtttcggc

SEQ ID NO: 1540 - DNA, 265 bp, Glycine max
tgggaccaaagactccatcagaaagcttgtctctgacttgaacagtgcaacattggagtctgatgttgatgttgttgttgcacctccttttgtgtacatcgatcaggtgaaaaactcaattacagataggattgaaatttctgcccagaattcttgggtgggaaaaggtggggctttcacgggagaaatcagtgtggagcaactaaaagaccttggctgcaagtgggttattcttggacattctgagcgaagacatgtaattgga

SEQ ID NO: 1541 - DNA, 259 bp, Glycine max
ggcaactggaagtgtaacgcaacaaaagactcaatcagcaagcttgttgctgacttgaacaatgcaaaattggagcctgatgttgatgttgtcgttgcacctcccttcctctacatcgatcaagtgaaaaactcactcactgagcggcttgacatatctgcccagaattcttgggttggaaaaggtggtgcttttactggagaaatcagcgcggaacaactaaacgatcttggatgcacgtgggttgttcttggacatt

SEQ ID NO: 1542 - DNA, 245 bp, Glycine max
gcaacctcaacatccctcttctcctcaaatctccattctctcaactcacagcctttctcttcctcactctccttcttccgaaatgtccattccaccctctctttcccttcttctaaaccctcccgtggcgttgtagccatggctggctctggcaagttctttgttggtggcaattggaagtgtaatgggaccaaagactccatcagaaagcttgtctctgacttgaacagtgcaacattggagtc

SEQ ID NO: 1543 - DNA, 283 bp, Glycine max
agatgcaccactctttcttcttcaatcaatggcagcaacctcaacatccctcttctcctcaaatctccattctctcaactcacaacctttctcttcctcactctccttcttctgaaatgtccattccaccctctctttcccttcttctaaaccctcccgtggcgttgtagccatggctggctctggcaagttctttgttggtggcaattggaagtgtaatgggaccaaagactccatcagaaagcttgtctctgacttgaacagtgcaacattggagtctgat

SEQ ID NO: 1544 - DNA, 249 bp, Glycine max
ctcgagccgcttcaatcaatggcagcaacctcaacatccctcttctcctcatatctccattctctcaactcataacctttctcttcatcactctccttccgaaatgtccattccactctctctttcccttcttctaaaccctctcgtggcgttgtagccatggctggctctggcaagttctttgatggtggcaattggaagtgtaatggtaccaaagactccatcagacagcttgtctctgttttgaac

SEQ ID NO: 1545 - DNA, 278 bp, Glycine max
  unsure (1)..(278): unsure at all n locations
cattcctaggtaccatttgcaccactctttcttcttcaatcaatggcagcaacctcaacatccctcttctcctacaaatctccattctctcaactcacaacctttctcttcctcactctccttnagccngtccattccaccctctctnncanaacantctaaaccctcccgtggcgttgtagccatggctggctctggcaagtnctttgttggtggcaattggaagtgtaatgggaccaaagactccatcagaaagttgtctctggattgaacaggca

SEQ ID NO: 1546 - DNA, 268 bp, Glycine max
attcaatccaagcttagattgttttactgttacaccattcctaggtaccatttgcaccactctttcttcttcaatcaatggcagcaacctcaacatccctcttctcctcaaatctccattctctcaactcacaacctttctcatcctcactctccttcttccgaaatgtccattccaccctctctttcccttcttataaaccctcccgtggcgttgtagccatggctggctctggcaagttctttgttggtggcaattggaagtgtaa

SEQ ID NO: 1547 - DNA, 289 bp, Glycine max
aaatttctgcccagaattcttgggtgggaaaaggtggggctttcacgggagaaatcagtgtggagcaactaaaagaccttggctgcaagtgggttattcttggacattctgagcgaagacatgtaattggagaaaatgatgagtttataggaaagaaaactgcctatgctttgagtgagggtcttggtgtgatagcatgtattggggaacttctacaagaaagagaagctggtcaaactttcgacatttgtttccagcaattgaaggcttttgcagatgcagtgccaag

SEQ ID NO: 1548 - DNA, 270 bp, Glycine max
gaaatttctgcccagaattcttgggtgggaaaaggtggggctttcacgggagaaatcagtgtggagcaactaaaagaccttggctgcaagtgggttattcttggacattctgagcgaagacatgtaattggagaaaatgatgagtttatagggaagaaggctgtctatgctttgagtgagggtctaggtgtgatagcatgtattggggaactgttacaagaaagagaagctgggaaaactttcgatgtttgttttcagcaattgaaggct

SEQ ID NO: 1549 - DNA, 281 bp, Glycine max
gtgaaaaactcactcactgagcggattgaaaatctgcccagaattcttgggttggaaaaggtggtgctcttactggagaaatcagcgcggaacaactaaaagatcttggatgcaagtgggttgttcttggacattctgagcgaagacatgttattggagaaaatgatgagtttatagggacgaaagctgcctatgctttgagccaaggtcttggggtgattgcatgcattggagaattgttagaagaaagggaggctggaaaaacttttgatgtttgtttt

SEQ ID NO: 1550 - DNA, 223 bp, Glycine max
acggctgcgagaagacgacagaagggtggaaaaggtggtgcttttactggagaaatcagcgcggaacaactaaaagatcttggatgcaagtgggttgttcttggacattctgagcgaagacatgttattggagaaaatgatgagtttatagggaagaaagctgcctatgctttgagccaaggtcttggggtgattgcatgcattggagaattgttagaagaca

SEQ ID NO: 1551 - DNA, 170 bp, Glycine max
  unsure (1)..(170): unsure at all n locations
cactgagcggattgaaatatctgcccagaattcttgggttggaaaaggtggtgcttttactggagaaatcagcgcggaacaactaaaagatcttggatgcaagtnggttgttcttggacattctnagcgaagacatgttattggngaaaatgatgagtttatagggaaga

SEQ ID NO: 1552 - DNA, 355 bp, Glycine max
  unsure (1)..(355): unsure at all n locations
gtttcggcacaaaactgttgggttcgcaaaggtggtgcttataccggtgaggttagtgctgtcatgcttgttaatttgggaattccttgggttattattggtcactctgaacggaggcagcttttaaatgaatcaaacgagtttgtgggagataaagttgcctatgcacttcaacaaggtctaaaagttattgcatgcattggggagactctcgaacagcgtgaagctggtacaacaacggctgttgtttctgagcaaacaaaagcaattgcagctanaatatcaaattgggacaatgttgtcttggcctacgagccagtttggggcattggaacaggaaaggttgctactcctg

SEQ ID NO: 1553 - DNA, 275 bp, Glycine max
  unsure (1)..(275): unsure at all n locations
gagcaaacaaaagcaattgcagctaaaatntcaaattgggacaatgtcgttttggcctatgagccagtttgggccattggaacaggaaaggttgcaactcctgctcaggctcaagaggttcatgctgatttaaggaaatgggttcatgacaatgtgagtgctgaagttgctgcatctgtaagaattatctatggaggctctgtaaatggaggaaactgcaaagaattggcagcacagcccgatgttgatggatttttggttggtggtgcatccct

SEQ ID NO: 1554 - DNA, 268 bp, Glycine max
gtgggagataaagttgcctatgcacttcaacaaggtctaaaagttattgcatgcattggggagactctcgaacagcgtgaagctggtacaacaacggctgttgtttctgagcaaacaaaagcaattgcagctaaaatatcaaattgggacaatgtcgttttggcctacgagccagtttgggccattggaacaggaaaggttgctactcctgctcaggctcaagaggtccatgctgatttgaggaaatgggttcatgacaatgtgagtg

SEQ ID NO: 1555 - DNA, 264 bp, Glycine max
gtgggagataaagttgcctatgcacttcaacaaggtctgaaagttatagcatgcattggggaaactcttgaacagcgtgaagctggtacaacaacggctgttgttgctgagcaaacaaaagcaattgcagctaaaatatcaaattgggacaatgtcgttttggcctatgagccagtttgggccattggaacaggaaaggttgcaactcctgctcaggctcaagaggttcatgctgatttaaggaaatgggttcatgacaatgtg

SEQ ID NO: 1556 - DNA, 256 bp, Glycine max
catgcattggggacactcttgaacagcgtgaagctggtacaacaacggctgttgttgctgagcaaacaaaagcaattgcagctaaaatatcaaattgggacaatgtcgttttggcctatgagccagtttgggccattggaacaggaaaggttgcaactcctgctcaggctcaagaggttcatgctgatttaaggaaatgggttcatgacaatgtgagtgctgaaattgctgcatctgtaagaattatctatggagg

SEQ ID NO: 1557 - DNA, 270 bp, Glycine max
gtccctggagaagatgttgtagaagttgttgtgagccctccttttgtgttccttccttttgtaaaaagtttgctgcgccctgatttccatgtctcggcccaaaattgttgggttcgcaaaggtggtgcttatactggagtcgttagtgctgaaatgcttgttaatttgggaattccttgggttattattggtcactctgaacggaggcagcttttgaatgaatcaaatgagtttgtgggagataaagttgcctatgcacttcaacaaggt

SEQ ID NO: 1558 - DNA, 264 bp, Glycine max
cggagataaagttgcctatgcacttcaacaaggtctaacagttattgcatgcattggggagactctcgaacagcgtgaagctggtacaacaacggctgttgtttctgagcaaacaaaagcaattgcagctaaaatatcaaattgggacaatgttgttttggcctacgagccagtttgggccattggcacaggaaaggttgctactcctgctcaggctcaagaggtccatgctgatctgaggaaatgggttcatgacaatgtgag

SEQ ID NO: 1559 - DNA, 258 bp, Glycine max
  unsure (1)..(258): unsure at all n locations
gcattggggagactctcgaacagcgtgaagctggtacaacaacggctgttgtttctgagcaaacaaaagcaattgcagctaaaatatcaaattgggacaatgtcgttttggcctacgagccagtttgngccattggaacaggaaagnttgctactcctgctcaggctcaagaggtccatgcggatttgaggaaatgggttcatgacaatgtgagtgctgaagttgctgcatcggtaanatttatctanggaggtctgt

SEQ ID NO: 1560 - DNA, 278 bp, Glycine max
tgcttatactggagaggttagtgctgaaatgcttgttaatttgggaattccttgggttattattggtcactctgaacggaggcagcttttgaatgaatcaaatgagtttgtgggagataaagttgcctatgcacttcaacaaggtctgaaagttatagcatgcattggggaaactcttgaacagcgtgaagctggtacaacaacggctgttgttgctgagcaaacaaaagcaattgcagctaaaatatcaaattgggacaatgtcgttttggcctatg

SEQ ID NO: 1561 - DNA, 278 bp, Glycine max
ctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcgcaaaggtggtgcttataccggtgaggttagtgctgaaatg

SEQ ID NO: 1562 - DNA, 272 bp, Glycine max
aaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcaaaactgttgggttcgcaaaggtggtgcttataccggtgaggttagtgctgaaatgcttgttaatttggg

SEQ ID NO: 1563 - DNA, 264 bp, Glycine max
tacggctgcgagaagacgacagaaggggaagttgttgtgagccctccttttgtgttccttcctgttgtaaaaagtttgctgcgccctgatttccatgtttcggcacaaaactgttgggttcgcaaaggtggtgcttataccggtgaggttagtgctgaaatgcttgttaatttgggaattccttgggttattattggtcactctgaacggaggcagcttttaaatgaatcaaacgagtttgtgggagataaagttgcctatgca

SEQ ID NO: 1564 - DNA, 257 bp, Glycine max
ctcgagccggttgcaactcctgctcaggctcaagaggttcatgctgatttaaggaaatggactcatgacaatgtgagtgctgaagttgctgcatctgtaagaattatctatggaggctctgtaaatggaggaaactgcaaagaattggcagcacagcccgatgttgatggatttttggttggtgtggcatccctcaaggcggaatttgtggacatcataaacgctgctactgtgaagaagaattgaaattcgtagtt

SEQ ID NO: 1565 - DNA, 283 bp, Glycine max
cttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggttcgcaaaggtggtgcttatactggagatgttagtgctgaaatgc

SEQ ID NO: 1566 - DNA, 256 bp, Glycine max
  unsure (1)..(256): unsure at all n locations
aaaaaatcatgggcagaaaattcttcgtcggtggtcaactggaaatgcaatgggaccactgaggaggtgaagnagattgttactactttaaatgaagctaaagtccctggagaagatgttgtagaagttgttgtgagccctccttttgtgttccttccttttgtaaaaagtttgctgcgccctgatttccatgtctcggcccaaanttgttgggttcgcaaaggtggtgcttatactggagangntagtgctgaaa

SEQ ID NO: 1567 - DNA, 262 bp, Glycine max
gtaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggttcgcaaaggtggtgcttatactggagaggttagtgctgaaatgctt

SEQ ID NO: 1568 - DNA, 266 bp, Glycine max
gtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttctgtgttccttccttttgtaaaaagtttgctgcgccctgatttccatgtctcggcccaaaattgttgggttcgcaaaggtggtgcttat

SEQ ID NO: 1569 - DNA, 281 bp, Glycine max
  unsure (1)..(281): unsure at all n locations
gtagaagttgttgtgagccctccttttgtgttccttncttttgtaaaaagtttgctgcgccctgatttccatgtctcggcccaaaattgttgggttcgcaaaggtggtgcttatactggagaggttagtgctgaaatgcttgtnaatttgggaattcctgggttattattggtcactctgaacggaggcagcttttgaatgaatcaaatgagtttgtgggnccataaagttgcctatgcacttcaacaaggtctgaaattatagcatgcattgggccaacc

SEQ ID NO: 1570 - DNA, 284 bp, Glycine max
atcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcgcaaaggtggtgcttataccggtgaggttagtgc

SEQ ID NO: 1571 - DNA, 262 bp, Glycine max
gcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcgcaaaggtgg

SEQ ID NO: 1572 - DNA, 274 bp, Glycine max
  unsure (1)..(274): unsure at all n locations
ctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccntccttttgtgttccttccttttgtaaaaagtttgctgcgccctgatttccatgtctcggcccaaaattgttgggttcgcaaagtggtgctta

SEQ ID NO: 1573 - DNA, 253 bp, Glycine max
cactttctctcgtttcaatcgaaaaaaatcatgggcagaaaattcttcgtcggtggcaactggaaatgcaatgggaccactgaggaggtgaagaagattgttactactttaaatgaagtaaagtccctggagaagatgttgtagaagttgttgtgagccctccttttgtgttccttccttttgtaaaaagtttgctgcgccctgatttccatgtctcggcccaaaattgttgggttcgcaaaggtggtgctta

SEQ ID NO: 1574 - DNA, 284 bp, Glycine max
aagggtttctcttctctttctctgtctgcttcttcactttctctcgtttcaatcgaaaaaaatcatgggcagaaaattcttcgtcggtggcaactggaaatgcaattgggacactgaggaggtgaagaagattgttactactttaaatgaagctaaagtccctggagaagatgttgtagaagttgttgtgagccctccttttgtgttccttccttttgtaaaacgtttgctgcgccctgatttccatgtctcggcccaaaattgttgggttcgcaaaggtggtg

SEQ ID NO: 1575 - DNA, 278 bp, Glycine max
gcttcttcactttctctcgtttcaatcgaaagcaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctggcgccctgatttccatgtttcggcacaaaactgttgggttcgcaaaggtggtgcttataccggtga

SEQ ID NO: 1576 - DNA, 271 bp, Glycine max
aagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggt

SEQ ID NO: 1577 - DNA, 263 bp, Glycine max
gtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggtt

SEQ ID NO: 1578 - DNA, 285 bp, Glycine max
ctcgagccggttgaacaagggtttctctgtctgcttcttcactttctctcgtttcaatacgcaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggtcg

SEQ ID NO: 1579 - DNA, 269 bp, Glycine max
aagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcg

SEQ ID NO: 1580 - DNA, 253 bp, Glycine max
gcactttctctcgtttcaatcgaaaccaaactccaaacgtgggcagaaaattcttcgtcggtggcaactggaaatgccctgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcgcaaagg

SEQ ID NO: 1581 - DNA, 253 bp, Glycine max
gtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaatgttgggttcgcaaaggtggtgcttatactggagagt

SEQ ID NO: 1582 - DNA, 257 bp, Glycine max
ggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactg

SEQ ID NO: 1583 - DNA, 238 bp, Glycine max
ctttctctcgtttcaatcgaaaccaaaacaaaatcatgggcagaaaattcttcgttggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttg

SEQ ID NO: 1584 - DNA, 256 bp, Glycine max
ggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaact

SEQ ID NO: 1585 - DNA, 255 bp, Glycine max
tcgctgtctgcttcttcactttctctcgtttcaatcgagaccagaacaaaaacatgggcagaaaattcttcgtcggtggcaactggaaatgcaatgggatcactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacgaaactgtt

SEQ ID NO: 1586 - DNA, 259 bp, Glycine max
tctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaatgtcgtagaagttgttgtgagccctccttttgtgttccttcctgttgtaaaaagtttgctgcgccctgatttccatgtttcggcacaaaactgttgggttcgc

SEQ ID NO: 1587 - DNA, 250 bp, Glycine max
tgcttcttcactttctctcgtttcaatcgagaaaaatcatgggcagaagattcttcgtcggtggcaactggaaatgcaatgggaccactgaggaggtgaagaagattgtgactactttaaatgaagctaaagtccctggagagatgttgtagaagttgttgtgagccctccttttgtgttccttccttttgtaaaaagtgtgctgcgccctgatttccatgtctcggcccaaaattgttgggttcgcaaa

SEQ ID NO: 1588 - DNA, 265 bp, Glycine max
attgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaa

SEQ ID NO: 1589 - DNA, 267 bp, Glycine max
gtttctctttctctttctctgtctgcttcttcactttctctcgtttcaatcgaaaaaaatcatgggcagaaaattcttcgtcggtggcaactggaaatgcaatgggaccactgaggaggtgaagaagattgttatactttaaatgaagctaaagtccctggagaagatgttgtagaagttgttgtgagccctccttttgtgttccttccttttgtaaaaagtttgctgcgccctgatttccatgtctcggcccaaaattgttgggtt

SEQ ID NO: 1590 - DNA, 250 bp, Glycine max
agggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtc

SEQ ID NO: 1591 - DNA, 251 bp, Glycine max
gttgaacaagggtttctctgtctgcttcttcactttctctcgtttcaatcgaaaccataacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgctctgatttccatg

SEQ ID NO: 1592 - DNA, 245 bp, Glycine max
cttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcgg

SEQ ID NO: 1593 - DNA, 253 bp, Glycine max
gggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcgg

SEQ ID NO: 1594 - DNA, 262 bp, Glycine max
tgttgaacaagggtttctctgtctgcttcttcactttctctcgtttcaatcgaaaccaaaacaaaatcatgggcagaaaattcttcgttggtggcaactggaaatgcaatgggaccactgaggaggtaaagaagattgttactactttgaatgaggctaaagtacctggagaagatgtcgtagaagttgttgtgagccctccttttgtgttccttcctgttgtaaaaagtttgctgcgccctgatttccatgtttcggcaca

SEQ ID NO: 1595 - DNA, 253 bp, Glycine max
  unsure (1)..(253): unsure at all n locations
agggtttctctgtctgcttcttcactttctctcgtttcaatcgaaaccaaaacaaaaacatgggcagaaaattcttcgtnggtggcaactggaaatgcaatgggaccactgaggaggtaaagaagattgttactactttgaatgaggctaaagtccctggngaagatgtcgtagaagttgttgtgagccctccttttgtgttccttcctgttgtaaaaagtttgctgcgccctgatttccatgtttcgnncac

SEQ ID NO: 1596 - DNA, 249 bp, Glycine max
gttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttcca

SEQ ID NO: 1597 - DNA, 248 bp, Glycine max
acaacaacggctgttgttgctgagcaaacaaaagcaattgcagctaaaatatcaaattgggacaatgtcgttttggcctatgcgccagtttgggccattggaacaggaaaggttgcaactcctgctcagggctcagaggttcatgctgattaaggaaatggggtcatgacaatgtgagttctgaagttgccgcatctgtaggaataatctatggaggctctgtaaatggaggaaactgcaaagaattg

SEQ ID NO: 1598 - DNA, 255 bp, Glycine max
  unsure (1)..(255): unsure at all n locations
gtattgttgaacaagggtttctctgtctgcttcttcactttctctcgtttcaatcganaccaanacaaaatcatgggcagaaaattcttcgttggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccat

SEQ ID NO: 1599 - DNA, 263 bp, Glycine max
gttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaa

SEQ ID NO: 1600 - DNA, 251 bp, Glycine max
tgttgaacaagggtttctctgtctgcttcttcactttctcacgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctaccttttgtgttcctacctgttgtaaaaagtttgctgcgccctgatttcca

SEQ ID NO: 1601 - DNA, 255 bp, Glycine max
tgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcgg

SEQ ID NO: 1602 - DNA, 246 bp, Glycine max
tgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatt

SEQ ID NO: 1603 - DNA, 249 bp, Glycine max
attgttgaacaagggtttctctgtctgcttcttcactttctctcgtttcaatcgaaaccaaaacaaaatcatgggcagaaaattcttcgttggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgattt

SEQ ID NO: 1604 - DNA, 227 bp, Glycine max
tgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtcccgggggaagatgtcgtagaagttgttgtgagccctccttttgtgttccttcctgttgtaaaaagtttgctgcgccctgatttcca

SEQ ID NO: 1605 - DNA, 266 bp, Glycine max
gttgagcaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtagaaagtttgctgcgccctgatttccatgtttcggcacaaaact

SEQ ID NO: 1606 - DNA, 258 bp, Glycine max
gttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggc

SEQ ID NO: 1607 - DNA, 242 bp, Glycine max
tgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccct

SEQ ID NO: 1608 - DNA, 252 bp, Glycine max
  unsure (1)..(252): unsure at all n locations
gttgaacaagggtttcnctgtcnccttcnncactttctctccgtttcaatcgaaaccaaaacaaaatcatgggcannaaattcttcgttggtggcaantgganatgcaatgggaccactgaggaggtaaagnagattgttactactttgaatgaggctaaagtccctggagaagatgtcgtagaagttgttgtgagccctcctttngtgttccttcctgttgtaaaaagtttgctgcgccctgatttccatg

SEQ ID NO: 1609 - DNA, 266 bp, Glycine max
tttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctggcgccctgatttccatgtctcggcccaaaattgttggg

SEQ ID NO: 1610 - DNA, 339 bp, Glycine max
  unsure (1)..(339): unsure at all n locations
gttgaacaagggtttctctgtctgcttcttcactttctctcgtttcaatcgaaaccaaaacaaaaacatgggcagaaaattcttcgtcggtggcaactggaaatgcaatggggaccactgaggaggtaaagaagattgttactactttgaatgaggctaaagtccctggagaagatgtcgtagaagttgttgtgagccctccttttgtgttccttcctgttgtaaaaagtttgctgcgccctgattccatgtttcggcacaaaactgttgggttcgcaaagtggtgcttataccggaggttagtgctgaaatgctgttaattgggaatcccctngggaa

SEQ ID NO: 1611 - DNA, 272 bp, Glycine max
attgtattgttgaacaagggtttctctgtctgcttcttcactttctctcgtttcaatcgaaaccaggttgaggacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaa

SEQ ID NO: 1612 - DNA, 264 bp, Glycine max
  unsure (1)..(264): unsure at all n locations
ggtttctctttctctttctcngtctgcttcntcactttctctcgtntcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttcctttgtanaaagtttgctgcgccctgatttnccatgtctcggcccaaaattgtt

SEQ ID NO: 1613 - DNA, 190 bp, Glycine max
ttaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttcca

SEQ ID NO: 1614 - DNA, 249 bp, Glycine max
caatgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctga

SEQ ID NO: 1615 - DNA, 257 bp, Glycine max
gttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaagtttgctgcgccctgatttccatgtttcggc

SEQ ID NO: 1616 - DNA, 237 bp, Glycine max
ctcgagccggttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctcttgtaaaaag

SEQ ID NO: 1617 - DNA, 245 bp, Glycine max
  unsure (1)..(245): unsure at all n locations
gtagaactgaacaagggtttctctttctctttctctgtctgcttcttcactttctctcgtttcaatcgcaaaaaaatcatgggcagaaaattcttcgtcggtggcaactggaaatgcaatgggaccactgaggaggtgaagaagattgttactactttaaatgaagctaaagtccctggagaagatgttnaagaagttgttgtgagccctccttttgtgttccttcctttgtaaaaagtttgctg

SEQ ID NO: 1618 - DNA, 259 bp, Glycine max
agggtttctctttctctttctctgtctgcttcttcactttctctcgttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaa

SEQ ID NO: 1619 - DNA, 241 bp, Glycine max
  unsure (1)..(241): unsure at all n locations
ggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttcctccttttgtaaaangtttgctgcgccctgatttc

SEQ ID NO: 1620 - DNA, 272 bp, Glycine max
tacggctgcgagaagacgacagaaggggactcgcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagt

SEQ ID NO: 1621 - DNA, 221 bp, Glycine max
tgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgtt

SEQ ID NO: 1622 - DNA, 266 bp, Glycine max
aacggctgcgagaagacgacagaagggggcagttgtattgttgaacaagggtttctctgtctgcatcttcgctttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaa

SEQ ID NO: 1623 - DNA, 260 bp, Glycine max
ggctgcgagaagacgacagaaggggactcgcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgtt

SEQ ID NO: 1624 - DNA, 273 bp, Glycine max
gttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggt

SEQ ID NO: 1625 - DNA, 257 bp, Glycine max
  unsure (1)..(257): unsure at all n locations
ctctctctttctctgtctgcttcttcactttctctcgtttcaatcgaaaaaaatcatgggcagaaaattcttcgtcggtggcaactggnaatgcaatgggaccactgaggaggtgaagaagattgtnactactttaaatgaagctaaagtccctggagaagatgttgtagaagttgttgtgagccctcctttgtnctccatccttngtaaaaatttgcngcgcccgganttncatgtcngggccnaaattgttgggt

SEQ ID NO: 1626 - DNA, 272 bp, Glycine max
cgctgtttcgacggtcacacgcagttgtattgtagaactgaccaagggtttctctttctctttctctgtctgcttcttcactttctctcgtttcaatcgaaaaaaatcatgggcagaaaattcttcgtcggtggcaactggaaatgcaatgggaccactgatgaggtgaagaagattgttactactttaaatgaagctaaagtccctggagaagatgttgtagaagttgttgtgagccctccttttgtgttccttccttttgtaaaaagttt

SEQ ID NO: 1627 - DNA, 253 bp, Glycine max
tacggctgcgagaagacgacagaaggggactcgcagttgcattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgtt

SEQ ID NO: 1628 - DNA, 148 bp, Glycine max
aaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgt

SEQ ID NO: 1629 - DNA, 268 bp, Glycine max
tacggctgcgagaagacgacagaagggggcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagt

SEQ ID NO: 1630 - DNA, 265 bp, Glycine max
acggtcacacgcagttgtattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgct

SEQ ID NO: 1631 - DNA, 274 bp, Glycine max
gtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgcgctgatttccatgtctcggcccaaaa

SEQ ID NO: 1632 - DNA, 255 bp, Glycine max
  unsure (1)..(255): unsure at all n locations
ctttctctttctctgtctgcttcttcactttctctcgtttcaatngaaaaaaatcatgggnagaaaattcttcgtgcggtggcaactggaaatgcaatgggaccanttangacgtgaanaagnttnttantactttaaatnnngntaaagtccctggagangatgttgtagnnnttgttgtgagccctcctttngtgtnccttcctnntgtaaaangtttnctgcgcncngatttccntgtctcggcccanaatt

SEQ ID NO: 1633 - DNA, 262 bp, Glycine max
cgagaagacgacagaagggggcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagcctccttttgtgttcttcctgttgtaaaagttgctg

SEQ ID NO: 1634 - DNA, 264 bp, Glycine max
gttgaacaagggtttctctgtctgcttcttcactttctctcgtttcaatcgaaaccaaaacaacaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtacaaagtttgctgcgccctgatttccatgtttcggcacaaaa

SEQ ID NO: 1635 - DNA, 254 bp, Glycine max
gggtttctctttctctttctctgactgcttcttcactttctctcgttgcaatcgaaaaaaatcatgggcagaaaattcttcgtcggtggcaactggaaatgcaatgggaccactgaggaggtgaagcagattgttactactttaaatgaagctaaagtccctggagaagatgttgtagacgttgttgtgagccctccttttgtgttccttccttttgtaaaaagtttgctgcgccctgatttccatgtctcgga

SEQ ID NO: 1636 - DNA, 234 bp, Glycine max
tacggctgcgagaagacgacagaagggggcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgag

SEQ ID NO: 1637 - DNA, 193 bp, Glycine max
gtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgccgtagaagttgttgtgagccct

SEQ ID NO: 1638 - DNA, 300 bp, Glycine max
  unsure (1)..(300): unsure at all n locations
acggctgcgagaagacgacagaaggggacacgcagttgtattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctanagtccctggagaagatgttgtagaagttgttgtgagcctccttttgtgttcttccttttgtaaaaattgctgcgcctgattccagtctc

SEQ ID NO: 1639 - DNA, 240 bp, Glycine max
aggctgtattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagcctccttttgtgttccttcttttgt

SEQ ID NO: 1640 - DNA, 278 bp, Glycine max
  unsure (1)..(278): unsure at all n locations
ctgaacaagggtttctctttctctttctctgtctgcctcttcactttctctcgtttcaatcgaaaaaatcatgggcagaaaattcttccgtcggtggcaactggaaatgcaatgggaccactgaggaggtgaagaagattgttatactttaaatgaagctaaagtccctggagaagatgttgtagaagttgttgtgagccctccttttgtgttccttcctttgtaaaaagttngctgcgccctgatttccatgtctcggcccaaaattgttgggttcg

SEQ ID NO: 1641 - DNA, 263 bp, Glycine max
  unsure (1)..(263): unsure at all n locations
gttgaacaagggtttctctgtctgcttcttcactttctctcgtttcaatcgaaaccaaaacaaaaacatgggcagaaaattattcgtcggtggnaactggaaatgcnatgggacnactgaggaggtaaagaagattgttactactttgnatgaggcnaaagtccctggagangatgtcgtagaagttgttntgaggcctccttttgtgttncttcnccgttgtaaaaagtttgctgcgccctgatttccatgtttcggcacaa

SEQ ID NO: 1642 - DNA, 238 bp, Glycine max
aacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctg

SEQ ID NO: 1643 - DNA, 266 bp, Glycine max
  unsure (1)..(266): unsure at all n locations
gttgaacnagggtttctctntctgcttcttcactttctctcgttnccaatcgaaaccaaaacaaaatcatgggcagaaaattcttcgttggtggcaactggaaatgcaatgggaccactgangaggtaaagnagattgttactactttgaatgaggctaaagtccctggagaagatgtcgtagaagttgttgtgagccctcctttgtgttccttcctgttgtaaaaagtttgctgcgccctgatttccatgtttcggcananactg

SEQ ID NO: 1644 - DNA, 256 bp, Glycine max
gttgaacaagggtttctctgtctgcttcttcactttctctcgtttcaatcgaaaccaaaacaaaatcatgggcagaaaattcttcgttggtggcaactggaaatgcaatgggaccactgaggaggtaaagaagattgttactactttgaatgaggctaaagtccctggagaagatgtcgtagaagttgttgtgagcctccttttgtgttccttcctgttgtaaaaagtttgctgcgccctgatttccatgtttcgg

SEQ ID NO: 1645 - DNA, 250 bp, Glycine max
ctacagctggggactcgcagttgtattgttgaacaagggtttctctgtctgcttcttcactttctctcgtttcaatcgaaaccaaaacaaaaacatgggcagaaaattcttcgtctgtggcaactggaaatgcaatgggaccactgaggaggtaaagaagattgttactactttgaatgaggctaaagtccctggagaagatgtcgtagaagttgttgtgagccctcttttgtgttcctcctgttgtaaa

SEQ ID NO: 1646 - DNA, 264 bp, Glycine max
acggctgcgagaagacgacagaaggggactcgcagttgtattgttgaacaaggggttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtcctggaagaagatgtcgtagaagttgttgtgagccctccttttgtgttccttcctgttgt

SEQ ID NO: 1647 - DNA, 267 bp, Glycine max
gtagtactgatcaagggtgtctgtttctatgtctctgtgtgtttcgtcactttctctcgtttcaatcgaaaaagatcatgggtagaagattagtcgtcggtggcaactggaaatgcaatgggaccactgaggaggtgaagaagattgttactactttaaatgaggctaaagtccctggagaagatgttgttgaagttgttgtgagccgccttttgtgttcctccttttgtagaggtttgctgcgcctggatttccatgtctcggccc

SEQ ID NO: 1648 - DNA, 238 bp, Glycine max
gtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagcctccttttgtgttccttcctttgtaaaaagtt

SEQ ID NO: 1649 - DNA, 273 bp, Glycine max
gaacaagggtttctctttctctttctctgtctgcttcttcactttctctcgtttcaatcgaaaaaaatcatgggcagaaaattcttcgtcggtggcaactggaaatgcaatgggaccactgaggaggtgaagcagattgttactactttaaatgaagctacagtccctggagaagatgttgtagaagttgttgtgagccctccttttgtgttccttccttttgtaaaaagtttgctgcgccctgatttccatgtctcggcccaaaattgttgg

SEQ ID NO: 1650 - DNA, 240 bp, Glycine max
acggctgcgagaagacgacagaaggggactcgcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggaagagatgtcgtagaagttgttgtgagccc

SEQ ID NO: 1651 - DNA, 252 bp, Glycine max
  unsure (1)..(252): unsure at all n locations
gcgcattattataaagagtgataaggttgtttggacggtcnntcgcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtcccggagaagatgtcgtagaagttgttgtgagccc

SEQ ID NO: 1652 - DNA, 274 bp, Glycine max
gtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagcccctggagaagatgttgtagaagttgttgtgagccctccttttgtgttccttccttttgtaaaaagtttgctgcgcgctgatttccatgtctcggcccaaaa

SEQ ID NO: 1653 - DNA, 185 bp, Glycine max
gttgaacaagggtttctctgtctgcttcttcactttctctcgtttcaatcgaaaccaaaacaaaatcatgggcagaaaattcttcgttggtggcaactggaaatgcaatgggaccactgaggaggtaaagaagattgttactactttgaatgaggctaaagtccctggagaagatgtcgtagaag

SEQ ID NO: 1654 - DNA, 215 bp, Glycine max
gcttcttcactttctctcgtttcaatcgaaaaaaatcatgggcagaaaattcttcgtcggtggcaactggaaatgcaatgggaccactgaggaggtgaagaagattgttactactttaaatgaagcgtaagtcgctggaggagaatgtgtagaagtggttgtgagcctcctttttgtgtccttccttttttaaaaaatttgctggggcctgattt

SEQ ID NO: 1655 - DNA, 266 bp, Glycine max
gaggaaactgcaaagaattggcagcacagcccgatgttgatggatttttggttggtggtgcatccctcaaggcggaatttgtggacatcataaacgctgctactgtgaagaagaattgaaattcgtagttaggaactgataatgctgcctttcaagctgcttcggaaattgctgtttttgagttttggttctgtgctttgtggccaatgtattgaactctgtttagtacctgaataaacatgctttcctttgatctcatccatagg

SEQ ID NO: 1656 - DNA, 248 bp, Glycine max
cgaaactgcaaagaattggcagcacagcccgatgttgatggatttttggttggtggtgcatccctcaaggcggaatttgtggacatcataaacgctgctactgtgaagaagaattgaaattcgtagttaggaactgataatgctgcctttcaagctgcttcggaaattgctgtttttgagttttggttctgtgctttgtggccaatgtattgaactctgtttagtacctgaataaacatgctttcctt

SEQ ID NO: 1657 - DNA, 254 bp, Glycine max
aaagaattggcagcacagcccgatgttgatggatttttggttggtggtgcatccctcaaggcggaatttgtggacatcataaacgctgctactgtgaagaagaattgaaattcgtagttaggaactgatatgctgcctttcaagctgcttcggaaattgctgtttttgagttttggttctgtgctttgtggccaatgtattgaactctgtttagtacctgaataaacatgctttcctttgatctcatccatagg

SEQ ID NO: 1658 - DNA, 225 bp, Glycine max
aaagaattggcagcacagcccgatgttgatggatttttggttggtggtgcatccctcaaggcggaatttgtggacatcataaacgctgctactgtgaagaagaattgaaattcgtagttaggaactgataatgctgcctttcaagctgcttcggaaattgctgtttttgagttttggttctgtgctttgtggccaatgtattgaactctgtttagtacctgaata

SEQ ID NO: 1659 - DNA, 258 bp, Glycine max
aaagaattggcagcacagcccgatgttgatggatttttggttggtggtgcatcactcaaggcggaatttgtggacatcataaacgctgctactgtgaagaagaattgaaattcgtagttaggaactgataatctgcctttcaagctgcttcggaaattgctgtttttgagttttggttctgtgctttgtggccaatgtattgaactctgtttagtacctgaataaacatgctttcctttgatctcatccataggcgat

SEQ ID NO: 1660 - DNA, 145 bp, Glycine max
gaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgt

SEQ ID NO: 1661 - DNA, 180 bp, Glycine max
agaaaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtaga

SEQ ID NO: 1662 - DNA, 98 bp, Glycine max
ttgttttggcctacgagccagtttgggccattggaacaggaaaggttgctactcctgctcaggctcaagagggtccatgctgatttgaggaaatgggt

SEQ ID NO: 1663 - DNA, 147 bp, Glycine max
gctcgaggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactt

SEQ ID NO: 1664 - DNA, 265 bp, Glycine max
  unsure (1)..(265): unsure at all n locations
gtttctctntctctntctctgtctgcttcttcactttctctcgtttcantcganaaaaatcatgggcagaaaattctcgtcggtggcaactggaaatgcaatgggaccactgaggaggtgaagaagattgtngnnacttaaattgaagccnaaatccccttggggaaatgttgtagannttgttgtgagccctccttttgtgttccttcctntgtaaaaagtttgctgcgccctgattnccagtctcgggcccanaatggtggng

SEQ ID NO: 1665 - DNA, 162 bp, Glycine max
aactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagc

SEQ ID NO: 1666 - DNA, 150 bp, Glycine max
cgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactacttt

SEQ ID NO: 1667 - DNA, 263 bp, Glycine max
caaagataattcttacagatgcagcacagcccgatgttgatggatttttggttggtggtgcatccctcaaggcggaatttgtggacatcataaacgctgatactgtgaagaagaattgaaattcgtagttaggaactgataatgctgcctttcaagctgcttcggaaattgctgtttttgagttttggttctgtgctttgtggccaatgtattgaactctgtttagtacctgaataaacatgctttcctttgatctcatccat

SEQ ID NO: 1668 - DNA, 247 bp, Glycine max
aaagaattggaagcacagcccgatgttgatggatttttggctggtggtgcatccctcaaggcggaatttgtggacatcataaacgctgctactgtgaagaagaattgaaattcgtagttaggaactgataatgctgcctttcaagctgcttcggaaattgctgtttttgagttttggttctgtgctttgtggccaatgtattgaactctgtttagtacctgaataaacatgctttcctttgatctca

SEQ ID NO: 1669 - DNA, 195 bp, Glycine max
tacggctgcgagaagacgacagaaggggacacgcagttgtattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttact

SEQ ID NO: 1670 - DNA, 271 bp, Glycine max
  unsure (1)..(271): unsure at all n locations
cttattggaganaatgatgagtttatagggaaganagctgcctatgctttgagccaaggtcttggggtgattgcatgcattggagacttgttagaagaaagggaggctggaaaaactactgatgtttgtnttcagcaattgaaggcttatgcagacgcagttgctagttgggacaacattgttattgcatatgaacctgtatgggccattggaacgggcaaagtcgccactccccaacaagctcaggaagtacatgtagctgttcgggatt

SEQ ID NO: 1671 - DNA, 322 bp, Glycine max
cttcgatggcggcaacctcaacatcactggcttctcaactctacattggcctgcgccgcccctgcctcaagctcgattctttcaattctcaatctttctctctcttcgaccctaatcttcgcctatccctctctccacccaaaccctcacgcgccgtcatcgccatggccggcaccgggaagttctttgttggtggcaactggaagtgtaacggaacaaaagactcaatcagcaagcttgttgctgacttgaacaatgcaaaattggagcctgatgttgatgttgtcgttgcacctcccttcctctacatcgatcaagtgaa

SEQ ID NO: 1672 - DNA, 249 bp, Glycine max
gcaacctcaacatcactggcttctcaactctacattggcctgcgccgcccctgcctcaagctcgattctttcaattctcaatctttctctctcttcgaccctaatcttcgcctatccctctctccacccaaaccctcacgcgccgtcatcgccatggccggcaccgggaagttctttgttggtggcaactggaagtgtaacggaacaaaagactcaatcagcaagcttgttgctgacttgaacaatgca

SEQ ID NO: 1673 - DNA, 257 bp, Glycine max
ggcaacctcaacatcactggcttctcaactctacattggcctgcgccgcccctgcctcaagctcgattctttcaattctcaatctttctctctcttcgaccctaatcttcgcctatccctctctccacccaaaccctcacgcgccgtcatcgccatggccggcaccgggaagttctttgttggtggcaactggaagtgtaacggaacaaaagactcaatcagcaagcttgttgctgacttgaacaatgcaaaattgg

SEQ ID NO: 1674 - DNA, 275 bp, Glycine max
gtttttgttcttcgatggcggcaacctcaacatcactggcttctcaactctacattggcctgcgccgcccctgcctcaagctcgattctttcaattctcaatctttctctctcttcgaccctaatcttcgcctatccctctctccacccaaaccctcacgcgccgtcatcgccatggccggcaccgggaagttctttgttggtggcaactggaagtgtaacgggaacaaaagactcaatcagcaagcttgttgctgacttgaacaatgcaaaatt

SEQ ID NO: 1675 - DNA, 287 bp, Glycine max
ctgtgttcctgtttttgttcttcgatggcggcaacctcaacatcactggcttctcaactctacattggcctgcgccgcccctgcctcaagctcgattctttcaattctcaatctttctctctcttcgaccctaatcttcgcctatccctctctccacccaaaccctcacgcgccgtcatcgccatggccggcaccgggaagttctttgttggtggcaactggaagtgtaacggaacaaaagactcaatcagcaagcttgttgctgacttgaacaatgcaaaattgga

SEQ ID NO: 1676 - DNA, 272 bp, Glycine max
  unsure (1)..(272): unsure at all n locations
gatggcggcaacctcaacatcactgggcttctcaactctacattggcctggcgccgcccctgcctcaagctcgattctttcaattctcaatctttctctctcttcgaccctaatcttcgccnatccctctctccacccaaaccctcacnacaccgtcatcgccatggccggcaccgggaagttctttgttggtggcaactggaagtgtaacggaacaaaagactcaatcagcaancttgttgctgacttgaacaatgcaaaattggagcctg

SEQ ID NO: 1677 - DNA, 287 bp, Glycine max
  unsure (1)..(287): unsure at all n locations
ctgtgttcctgtttttgttcttcgatggcggcaacctcaacatcactggcttctcaactctacattggcctgcgccgcccctgcctcaagctcgattctttcaattctcaatctttcnctctcttcgaccctaatcttcgcctatccctctctccacccaaaccctcacgcgccgtcatcgccatggccggcaccgggaagttctttgttggtggcaactggaagtgtaacgnaacaaaagactcaatcagcaagcttgttgctgacttgaacaatgcaaaattgga

SEQ ID NO: 1678 - DNA, 274 bp, Glycine max
tgtttttgttcttcgatggcggcaacctcaacatcactggcttctcaactctacattggcctgcgccgcccctgcctcaagctcgattctttcaattctcaatctttctctctcttcgaccctaatcttcgcctatccctctctccacccaaaccctcacgcgccgtcatcgccatggccggcaccgggaagttctttgttggtggcaactggaagtgtaacggaacaaaagactcaatcagcaagcttgttgctgcttgacatgcaaatggag

SEQ ID NO: 1679 - DNA, 247 bp, Glycine max
  unsure (1)..(247): unsure at all n locations
ctgtgttcctgtttttnttcttcgatggcggcaacctcaacatcactggantctcaactctacattggcctgcgccgcccctgtctcaagctcgattctttcaattctcaatctttctctctcttcgaccctaatcttcgcctatccctctctccacccaaaccctcacgcgccgtcatcgccatggccggcaccgggaagttctttgttggtggcaatggaagtgtaacgcaacaaaagactcaat

SEQ ID NO: 1680 - DNA, 241 bp, Glycine max
gttcctgtttttgttcttcgatggcggcaacctcaacatcactggcttctcaactctacattggcctgcgccgcccctgcctcaagctcgattctttcaattctcaatctttctctctcttcgaccctaatcttcgcctatccctctctccacccaaaccctcacgcgccgtcatcgccatggccggcaccgggaagttctttgttggtggcaactggaagtgtaaggaacaaaagactca

SEQ ID NO: 1681 - DNA, 253 bp, Glycine max
cactgtgttgctgtttttgttcttcgatggcggcaacctcaacatcactggcttctcaactctacattggcctgcgccgcccctgcctcaagctcgattctttcaattctcaatctttctctctgttcgaccctaatcttcgcctatccctctctccacccaaaccctcacgcgccgtcatcgccatggccggcaccgggaagttctttgttggtggcaactggaagtgtaacgaaacaaaagactcaatcag

SEQ ID NO: 1682 - DNA, 240 bp, Glycine max
ctcgagcgttttgttcttcgatggcggcaacctcaacatcactggcttctcaactctacattggcctgcgccgcccctgcctcaagctcgattctttcaattctcaatctttctctctcttcgaccctaacttcgcctatccctctctccacccaaaccctcacgcgccgtcatcgccatggccggcaccgggaagttctttgttggtggcaactggaagtgtaaggaacaaaagactca

SEQ ID NO: 1683 - DNA, 240 bp, Glycine max
gtgttcctgtttttgttcttcgatggcggcaacctcaacatcactggcttctcaactctacattggcctgcgccgcccctgcctcaagctcgattctttcaattctcaatctttctctctcttcgaccctaatcttcgcctatccctctctccacccaaaccctcacgcgccgtcatcgccatggccggcaccgggaagttctttgttggtggcaactggaagtgtaacggaacaaaaga

SEQ ID NO: 1684 - DNA, 198 bp, Glycine max
ctgacttgaacagtgcaacattggagtctgatgttgatgttgttgttgcacctccctttgtgtacatcgatcaggtgaaaaactcaattacagataggattgaaatttctgcccagaattcttgggtgggaaaaggtggggctttcacgggagaaatcagtgtggagcaactaaaagaccttggctgcaagtgggtta

SEQ ID NO: 1685 - DNA, 282 bp, Glycine max
ctcaattacagataggattcagattttcacctgatcgatgtacacaaagggaggtgcaacaacaacatcaacatcagactccactgttgcacctccctttgtgtacatcgatcaggtgaaaaactcaattacagataggattgaacttctgcccagaattcttgggtgggaaaaggtggggctttcacgggagaaatcagattggagcaactaaaagaccttggctgcaagtgggctattcttggacattctgagcgcagacatgtaattggagcaaatgat

SEQ ID NO: 1686 - DNA, 377 bp, Glycine max
ctttctctttctctgtctgcttcttcactttctctcgttggaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggttcgcaaaggtggtgcttatactggagaggttagtgctgaaatgcttgttaatttgggaattccttgggttattattggtcactctgaacggaggcagcttttgaatgaatcaaatg

SEQ ID NO: 1687 - DNA, 426 bp, Glycine max
ccgggccgacccaaacgtcagtacggctgcgagaagacaacagaagggggaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggttcgcaaaggtggtgcttatactggagaggttagtgctgaaatgcttgttaatttgggaattccttgggttattattggtcactctgaacggaggcagctttt

SEQ ID NO: 1688 - DNA, 405 bp, Glycine max
  unsure (1)..(405): unsure at all n locations
agtacggctgcgagaagacgacagaagggtgaatcaaacgagtttgtgggagataaagttgcctatgcacttcaacaaggtctaaaagttattgcatgcattggggagactctcgaacagcgtgaagctggtacaacaacggctgttgtttctgagcaaacaaaagcaattgcagctaaaatatcaaattgggacaatgttgttttggcctacgagccagtttgggccattggaacaggaaaggttgctactcctgctcaggctcaagaggtccatgctgatttgaggaaatgggttcatgacaatgtgagtgccgaagttgctgcatctgtaagaattatctatggaggttctgtaaatggaaganactgcaaaaaattggccgcacagcccgatgttgatgga

SEQ ID NO: 1689 - DNA, 387 bp, Glycine max
gtcacacgcagttgtattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggttcgcaaaggtggtgcttatactggagaggttagtgctgaaatgcttgttaatttgggaattccttgggttattattggtcactctg

SEQ ID NO: 1690 - DNA, 419 bp, Glycine max
ggtcgacgacgcgtccatacggcagcgagaagacgacagaaggggactcgcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcgcaaaggtggtgcttataccggtgaggttagtgctgaaatgcttgttaatttgggaattccttgggttattattggtcactctg

SEQ ID NO: 1691 - DNA, 400 bp, Glycine max
agacggctgcgagaagacgacagaagggggcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcgcaaaggtggtgcttataccggtgaggttagtgctgaaatgcttgttaattttgggattcccttggggtataatggtcactctga

SEQ ID NO: 1692 - DNA, 367 bp, Glycine max
ccggctcgacccacgagtaagcccacgcgtccgacggctgcgagaagacgacagaaggggattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggttcgcaaaggtggtgcttatac

SEQ ID NO: 1693 - DNA, 371 bp, Glycine max
agacggctgcgagaagacgacagaagggggcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcgcaaaggtggtgcttataccggtgaggttagtgctgaaatgcttgttaatttggga

SEQ ID NO: 1694 - DNA, 387 bp, Glycine max
acgcccacgcgtccgtacggctgcgagaagacgacagaaggggattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggttcgcaaaggtggtgcttatactggagaagttagtgctgaaatgcttgttaatttggga

SEQ ID NO: 1695 - DNA, 384 bp, Glycine max
  unsure (1)..(384): unsure at all n locations
gggccgagccacgcgtccatacggatgcgagaagacgacagaagggggtattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtanaagttgttgtgagccctccttttgtgttccttccttttgtaaaaagtttgctgcgccctgatttccatgtctcggcccaaaattgttgggttcgcaaaggtggtgcttatactggagaagttagtgctgaaatgcttgtt

SEQ ID NO: 1696 - DNA, 265 bp, Glycine max
gataaagttgcctatgcacttcaacaaggtctaaaagttattgcatgcattggggagactctcgaacagcgtgaagctggtacaacaacggctgttgtttctgagcaaacaaaagcaattgcagctaaaatatcaaattgggacaatgtcgttttggcctacgagccagtttgggccattggaacaggaaaggttgctactcctgctcaggctcaagaggtccatgctgatttgaggaaatgggttcatgacaatgtgagtgctg

SEQ ID NO: 1697 - DNA, 421 bp, Glycine max
gttcgcaaaggtggtgcttatactggagaggttagtgctggaatgcttgttaattggggaattccttgggttattattggtcactctgaacggaggcagcttttgaatgaatcaaatgagtttgtgggagataaagttgcctatgcacttcaacaaggtctgaaagttatagcatgcattggggaaactcttgaacagcgtgaagctggtacaacaacggctgttgttgctgagcaaacaaaagcaattgcagctaaaatatcaaattgggacaatgtcgttttggcctatgagccagtttgggccattggaacaggaaaggttgcaactcctgctcatgctcaagaggttcatgctgatttaaggaaatgggttcatgacaatgtgagtgctgaagttgctgcatctgtaagaattatct

SEQ ID NO: 1698 - DNA, 325 bp, Glycine max
  unsure (1)..(325): unsure at all n locations
acgaccacgcgtccgtacggctgcgagaagacgacagaaggggactcgcagttgtattgttgaacaagggtttctctgtctgcttcttcactttctctcgtttcaatcgaaaccaaaacaaaaacatgggcagaaaattcttcgtcggtggcaactggaaatgcaatgggaccactgangaggtaaagaagattgttactactttgaatgaggctaaagtccctggagaagatgtcgtagaagttgttgtgagccctccttttgtgttccttcctgtcgtaaaaagtttgctgcgccctgatttccatgtttcggcacaaaactg

SEQ ID NO: 1699 - DNA, 393 bp, Glycine max
  unsure (1)..(393): unsure at all n locations
aaaagacgacagaaagggaatcccaatttgaatggttaacaaagggttccccggccggctcctcaacttccccccgttccaaccaaacccaaaccaaaatcatgggcaaaaaatcctccgccggtggcaactggaaatgcaatgggaccactgaagaggtaaagaaaattgttactactttgaatgacgctaaagtccctggagaagatgtcgtagaagttgttgtgagccctccttttgtgttccttcctgttgtanaaagtttgctgcgccctgattcccatgtttcggcacaaaactgttgggttcgcaaaagtggtgcttataccggtgaggttagtgctgaaatgcttgttaatttgggaattccttgggttattattggtcactctg

SEQ ID NO: 1700 - DNA, 300 bp, Glycine max
tacggctgcgagaagacgacagaaggggactcgcagttgtattgttgaacaagggtttctctgtctgcttcttcactttctctcgtttcaatcgaaaccaaaacaaaaacatgggcagaaaattcttcgtcggtggcaactggaaatgcaatgggaccactggggaggtaaagaagattgttactactttgaatgaggctaaagtccctggagaagatgtcgtacaagttgttgtgagccctccttttgtgttccttcctgttgtaaaaagtttgctgcgccctgatttccatgtttcgg

SEQ ID NO: 1701 - DNA, 234 bp, Glycine max
agtacggctgcgagaagacgacagaaggggattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtacaagttgttg

SEQ ID NO: 1702 - DNA, 342 bp, Glycine max
cccacgcgtccgtacggctgcgagaagacgacagaaggggggtcacacgcagttgtattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctccggccaaaattgttgggt

SEQ ID NO: 1703 - DNA, 354 bp, Glycine max
ctcgagccgaatcggctcgagtgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcgcaaaggtggtgcttataccggtgaggttagtgctgaaatgcttgttaatttgggaa

SEQ ID NO: 1704 - DNA, 291 bp, Glycine max
cccaggcgtccgtacggctgcgagaggacgacagaagggggcagttgtattgttgaacaagggtttcgctgtctgcttcttcactttctctcgtttcaatcgaaacgaaaacaaaaacatgggcagaaaattcttcgtcggtggcaactggaaatgcaatgggaccactgaggaggtaaagaagattgttacgactttgaatgaggcgaaagtccctggagaagatatcgtacaagttgttgtgagccctccttttgtgttccttcctgtgggtaaaagtttgctgcgccc

SEQ ID NO: 1705 - DNA, 312 bp, Glycine max
tgaacaagggtttctctttctctttctctgtctgcttcttcactttctctcgtttcaatcgagggaaatcatgggcagaaaattcttcgtcggtggcaactggaaatgcaatgggaccactgatgaggtgaagaagattgttactactttaaatgaagctaaagtccctggagaagatgttgtagaagttgttgtgagcactccttttgtgttccttccgtttgtaaaaagtttgctgcgccctgatttccatgtctcggcccaaaattgttgggtacgcataggtgatgcttagactggagaagttagtgc

SEQ ID NO: 1706 - DNA, 395 bp, Glycine max
agtacggctgcgagaagacgacagaaggggatgagtttatagggaagaaagctgcctatgctttgagccaaggtcttggggtgattgcatgcattggagaattgttagaagaaagggaggctggaaaaacttttgatgtttgttttcagcaattgaaggcttatgcagacgcagttgctagttgggacaacattgttattgcatatgaacctgtatgggccattggaacgggcaaagtggccactccccaacaagctcaggaagtacatgtagctgttcgggattggctaaaaaagaatgtctcagatgaagttgcgtctaaaacacgaattatttatggagggtctgtaaatggaggcaacagtgctgaactggcaaagcaagaagatattgat

SEQ ID NO: 1707 - DNA, 403 bp, Glycine max
agtacggctgcgagaagacgacagaaggggatgagtttatagggaagaaagctgcctatgctttgagccaaggtcttggggtgattgcatgcattggagaattgttagaagaaagggaggctggaaaaacttttgatgtttgttttcagcaattgaaggcttatgcagacgcagttgctagttgggacaacattgttattgcatatgaacctgtatgggccattggaacgggcaaagtggccactccccaacaagctcaggaagtacatgtagctgttcgggattggctaaaaaagaatgtctcagatgaagttgcgtctaaaacacgaattatttatggagggtctgtaaatggaagcaacagtgctgaactggcaaagcaagaagatattgatggatttct

SEQ ID NO: 1708 - DNA, 254 bp, Glycine max
  unsure (1)..(254): unsure at all n locations
cttttcttctctctcaacaacntcaccngtcttcctcctngatcatgtccnacttcaagggcnagtaccatnntgagntgntctnctatgctgcgtacntcnncactcctggaaagggtatttcttgctgctgacgagtcaacagggacaacgggcaagcgttnggncagcatcagagtagagaacattgaatccaacaggcgagctcttagggngcagnctttcactgcccnngtgtncttcaatatctcant

SEQ ID NO: 1709 - DNA, 283 bp, Glycine max
  unsure (1)..(283): unsure at all n locations
tcacatgttcctaatagccaccatgtcttccttcaagcgcacattctcanatgagttgattgccagtgctacttatattggcaccccaggacttggtatgcttgcagctgatgagttaaccggcacaattgggaaacgtttggcgagcttcaacgtggagaatgttgaaacgaacaggcgcattcttcgtgagctcctattcactgctcccggttgtcttgagtgcctcagtggtgtcatcttgtttgaggaaaccctctaccaaatatcagctgcaggagta

SEQ ID NO: 1710 - DNA, 268 bp, Glycine max
tcaagcctagcgtctctcaactcaacaatgggtcttcttgacatcgtgcagccaggcgtcctcaacggtggggacgtcatgaaggtgtacaaatatgctcaggagcacaagtttgccatcccggccgtgaacgtgacatcgtcgtcgacgacgaatgccgctctgcaggccgcccgcgacatcaagtcgcccatcatcatccagacatcaaatggcggcgccgccttctacgctggcaaaggtattgacaacaagaaccagaacgcct

SEQ ID NO: 1711 - DNA, 261 bp, Glycine max
ggacgagaacatccccaaggcgcaaagcgcgttgctggtgaggtgcaaggcgaattctgaggctactcttggaacttacaagggggatgccacgcttggggaaggggcttctgagtctcttcatgttaaggattataagtactaagagagaggtgtgagattggttcttttggaatggaattgtttgtttctttgggcctgttttggatattcaagagtgtttttcaaaaaatttctactgaaaaggaaagaaattctcca

SEQ ID NO: 1712 - DNA, 277 bp, Glycine max
  unsure (1)..(277): unsure at all n locations
cnnatctacaagggtaactcacagcttnctgatggtgcctcagagagcctccatgtttcgaactacagctactgatcaatcgaagttggngttgtttgnaganactagtgcgagtaggantcggtatnatgggtacnacaaccgnatttcttgttgataagtantatngtggntngactcttcccngaatnatcgnttggnattnacnggatgtttnccagtgnncctnnatggccanttagtcatccagggtgttggtgaactggcaaccnggaag

SEQ ID NO: 1713 - DNA, 276 bp, Glycine max
ctttaccagtcgacaacagatggaaataaatttgtggattgcctccgcgatcagaacattgtgcccggcatcaaagttgataagggtctggtccctctgccagggtcaaacaatgagtcttggtgccaagggctggatggttggcttctaggtctgctgaatactacaagcaaggtgctcgatttgccaagtggaggacagttgttagcattccatgtggtccttctgcattagctgtcccggaagcagcgtgggggcttgcacgttatgctgcta

SEQ ID NO: 1714 - DNA, 256 bp, Glycine max
  unsure (1)..(256): unsure at all n locations
agttcccagtattaactgatcatatacttacatttggtgaaggacagattaaatttgaagataatgtggatgaagtagtttcncaaaatggcccacgcgacgttngnggnnttctagaacacacttcgttntgttcntctctnttcntggnaagggtnttcttgctgctgatgagtcaacagggacaattggcaagcgtttgggcagcatcagtgtagagaacattgaatccaacaggcgatctcttagggagctg

SEQ ID NO: 1715 - DNA, 191 bp, Glycine max
  unsure (1)..(191): unsure at all n locations
ggctttatttgccaggtgcaatgcaaactcacatgcaactttgggaacttacnaaggtgatgctacccttgctgagggtgcctccgagtctctccatgtcnaggactacaaatactaactaaaggtgttgacttctttaatttggagaatttttgcactattggctacaccattctcatgttcttccttca

SEQ ID NO: 1716 - DNA, 248 bp, Glycine max
tgcaatgcaagctcacatgcaactttgggaacttgcaaaggtggtgctacccttgctgagggtgcctctgagtctctccatgtcaaggactacaaatactaactaaaggtgttgacttcttttaatttggagaatttttgcgctattggctacaccattctcatgttctttccttcgtagaagttagactcggccgatttgctttctgctctcggttataggatgtctacggattggggtgtaatcgc

SEQ ID NO: 1717 - DNA, 263 bp, Glycine max
acaccaaattaacaaagccttctttttcttgtgtgatctcacaagcccctaaaggccaccatgtcttccttcaagagcaaattccaagatgagttgattgccaatgctagttacattggcaccccaggaaagggtatccttgcggctgacgagtcaacagggacaattgggaagcgtttggcgagcatcaacgtggagaatgttgaaacaaacaggcgcattcttcgtgagctcctattcactgcccctggttgtcttgagcg

SEQ ID NO: 1718 - DNA, 258 bp, Glycine max
cacaccaaattaacaaagccttctttttcttgtgtgatctcacaagcccctaaaggccaccatgtcttccttcaagagcaaattccaagatgagttgattgccaatgctagttacattggcaccccaggaaacggtatccttgcggctgacgagtcaacagggacaattgggaagcgtttggcgagcatcaacgtggagaatgttgaaccaaaaaggggaatcctccgtgagctcctattcactgcccctggttgtct

SEQ ID NO: 1719 - DNA, 337 bp, Glycine max
ctcaagtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtct

SEQ ID NO: 1720 - DNA, 283 bp, Glycine max
cctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgt

SEQ ID NO: 1721 - DNA, 382 bp, Glycine max
  unsure (1)..(382): unsure at all n locations
ctcccaccaacttcaccgtcttcttcctcgatcatgtctcacttcaagggcaagtaccatgatgagcttattgccaatgctgcttacattggcaattcctggaaagggattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggagctggtgtgcttctggcacaaggtgaccaaggcnagttgacttctggantaatggagaaccacat

SEQ ID NO: 1722 - DNA, 314 bp, Glycine max
aggagaatggcctggttcccattgttgagcctgagatccttgttgatggacctcatgacattcacaagtgtgccgccgtcaccgagcgtgtccttgcagcatgctacaaggctttgaatgatcaccatgtccttcttgagggtaccctattgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctc

SEQ ID NO: 1723 - DNA, 288 bp, Glycine max
ctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatcaaggttgacaagggcacagtcgagcttg

SEQ ID NO: 1724 - DNA, 279 bp, Glycine max
ccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcattctctttgaggaaactctctaccagagcacagctgcaggcaagccctttgtggaagtcttgaaggaggctggtgtgcttcctgg

SEQ ID NO: 1725 - DNA, 288 bp, Glycine max
  unsure (1)..(288): unsure at all n locations
gagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggaggctggtgtgcttcctggcatcaaggttgacaagggcanagttgagcttgctggcactaatggagaaaccaccactcagggtctagatggccttggtcagcgttgcgccaagtactatgaagccggtgcacgttttgcc

SEQ ID NO: 1726 - DNA, 319 bp, Glycine max
  unsure (1)..(319): unsure at all n locations
gaacgcctatggcttgcgctagttacgctgtcatatgccaggagaatggcctggttcccattgttgagcntgagatcctngttgatggacctcatgacattcacaagtgtgccgccgtcaccgagcgtgtccttgcagcatgctacaaggctttgaatgatcaccntgtccttcttgagggtaccctattgaagccnaacatggtcacccctggntcccaatctgctaaggtttcccctcaggtggttgccgagcacactgtcagagcccttcagagaaccgtgcctgctgcagttcctgctgtcgttttctngtctgg

SEQ ID NO: 1727 - DNA, 276 bp, Glycine max
cttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagacagctgcaggcaagccctttgtgaatgtcttgaaggaa

SEQ ID NO: 1728 - DNA, 263 bp, Glycine max
cgagctcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttgtgccaagtactacgaagctggtgcacgttt

SEQ ID NO: 1729 - DNA, 285 bp, Glycine max
tcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaaggaagctggtgtgc

SEQ ID NO: 1730 - DNA, 278 bp, Glycine max
gggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggaggctggtgttcttcctggcatcaaggttgacaagggcacagttgagcttgctggcactaatggag

SEQ ID NO: 1731 - DNA, 265 bp, Glycine max
ctcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttgtgccaagtactacgaagctggtgcacgttttgccaa

SEQ ID NO: 1732 - DNA, 264 bp, Glycine max
cgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggca

SEQ ID NO: 1733 - DNA, 349 bp, Glycine max
  unsure (1)..(349): unsure at all n locations
tctagatggccttggtcagcgttgtgccaagtgctacgaagctggtgcacgttttgccaaatggcgtgcagtgctgaagattggtcccaacgagccatctgagctgtctatccatgagaacgncctatggcttggctagatacgctgtcatatgccaggagaatggcctggttcccattgttgagcctgagatccttgttgatggacctcatgacattcacaagtgtgccgccgtcaccgagcgtgtccttgcagcatgctacaaggcttgaatgatcaccatgtccttcttgagggtacctatgaagccaaaccatggtcaccctggatcccaatctgtaaggttccc

SEQ ID NO: 1734 - DNA, 273 bp, Glycine max
tgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggaggctggtgttcttcctggcatcaaggttgacaagggcacagttgagcttgctggcactaatggagaaac

SEQ ID NO: 1735 - DNA, 258 bp, Glycine max
atcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatattcagtggtgtcatcctctttgaggaaaccctctaccagagtacagctgcag

SEQ ID NO: 1736 - DNA, 267 bp, Glycine max
cttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgt

SEQ ID NO: 1737 - DNA, 259 bp, Glycine max
ggcgagctcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttgtgccaagtactacgaagctggtgc

SEQ ID NO: 1738 - DNA, 270 bp, Glycine max
tgcgtacattggcactcctggaaagggtattcttgctgctgatgagtcaacagggacaattggcaagcgtttggccagcatcagtgtagagaacattgaatccaacaggcgagctcttagggagctgcttttcactggtcctggtgttcttcaatatctcagtggtgtcatcctctttgaggaaaccctctaccagagcacagctgcaggcaagccctttgtgaatgtcttgaaggaagctggtgtgcttcctggcatcaaggttgacaa

SEQ ID NO: 1739 - DNA, 357 bp, Glycine max
  unsure (1)..(357): unsure at all n locations
gtccaacctacccctttttcttctcccaccaacttcaccgtnntcttcctcgatcatgtctcactncaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaatctctaccagcacagctgcaggcaagccctttgtggaatcttgaaggaggctggtgtgcttcctggcatc

SEQ ID NO: 1740 - DNA, 255 bp, Glycine max
atcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttgtgccaagtactacgaagctggtgcacgttttgccaaatggcgtgcagtgctgaagattggtcccaacgagccatctgagctg

SEQ ID NO: 1741 - DNA, 292 bp, Glycine max
atcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttgtgccaagtactacgaagctggtgcacgttttgccaaatggcgtgcagtgctgaagattggtcccaacgagccatctgagctgtctatcccatgagaacgctatggcttggctagatacc

SEQ ID NO: 1742 - DNA, 292 bp, Glycine max
  unsure (1)..(292): unsure at all n locations
ctctttttcttctctctcnacaacttcancttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccaggng

SEQ ID NO: 1743 - DNA, 265 bp, Glycine max
gtggttgccgagcacactgtcagagcccttcagagaaccgtgcctgccgcagttcctgctgtcgttttcttgtctggtggccagagtgaggaggaggcatctgtcaacctcaacgccattaaccaggtcaatgggaagaagccatggtcactctctttctcctttggaagggcacttcaacagagcacccttaaggcatggggcggaaaagaagagaatgtgaagaaggctcaggaagcccttttggtaagagccaaggctaact

SEQ ID NO: 1744 - DNA, 262 bp, Glycine max
tgcagatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaaggaa

SEQ ID NO: 1745 - DNA, 266 bp, Glycine max
  unsure (1)..(266): unsure at all n locations
accatgatnagcttatcgccaatgctgcgtacattggcactcctggaaagggtattcttgctgctgatgagtcaacagggacaattggcaagcgtttggccagnatcagtgtagagaacattgaatccaacaggcgagctcttagggagctgcttttcactgctcctggtgttcttcaatatctcagtggtgtcatcctctttgaggaaaccctctaccagaggacagctgcangcaagccctttgtgaatgtcttgaagggagct

SEQ ID NO: 1746 - DNA, 276 bp, Glycine max
ctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaacagagcacccttaaggcatggggcggaacagaagagaatgtgaagaaggctcaggaagcccttt

SEQ ID NO: 1747 - DNA, 248 bp, Glycine max
agggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaag

SEQ ID NO: 1748 - DNA, 300 bp, Glycine max
ctctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctcgtgttcttcaatatctcagtggtgtcatcctctttgaggaaaccctctaccag

SEQ ID NO: 1749 - DNA, 287 bp, Glycine max
gaacgcctatggcttggctagttacgctgtcatatgccaggagaatggcctggttcccattgttgagcctgagatccttgttgatggacctcatgacattcacaagtgtgccgccgtcaccgagcgtgtccttgcagcatgctacaaggcttgaatgatcaccatgtccttcttgagggtaccctattgaagccaaacatggtcacccctggatcccaatctgctaaggtttcccctcaggtggttgccgagcacactgtcagagcccttcagagaaccgtgcctgc

SEQ ID NO: 1750 - DNA, 254 bp, Glycine max
ctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttgtgccaagtactacgaagctggtgcacgttttgccaaatggcgtgcagtgctgaagattggtcccaacgagccatctgagctgtcta

SEQ ID NO: 1751 - DNA, 267 bp, Glycine max
caacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctct

SEQ ID NO: 1752 - DNA, 261 bp, Glycine max
  unsure (1)..(261): unsure at all n locations
cgatcatgtctcacttcaagggcaagtaccatgatgagcttattgtcaatgctgcttacattggcactcctggaaagggtattcttgctgctgatgagtcaacagggacaattggcaagcgtttggccagcatcgtgtagagaatgttgaatccaacaggcgtgctcttagggagctgcttttcaccgctcccggtgctcttaaatatctcagtggtgtcatcctctttgaggaaactctctaccagagnacagctgcagg

SEQ ID NO: 1753 - DNA, 267 bp, Glycine max
  unsure (1)..(267): unsure at all n locations
gggaggaggcatccgtcaacctcaacgccattaaccaggtcaatgggaagaagccatggtcactctctttctcctttggaagggcacttcaacagagcacccttaaggcatggggcggaaaagaagagaatgtgaagaaggctcaggaagcccttttggtaagagccaaggctaactcagaggcaactctgggaacctacaagggtaactcacagcttgctgatggtgcctcagagagcctncatgtttcgaactacagctactgat

SEQ ID NO: 1754 - DNA, 260 bp, Glycine max
ggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggaggctggtgttcttcctggcatcaaggttgacaagggcacagttgagcttgctggcactaatggagaaaccaccact

SEQ ID NO: 1755 - DNA, 289 bp, Glycine max
ctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaacc

SEQ ID NO: 1756 - DNA, 265 bp, Glycine max
ctcttagggagctgcttttcacgactcctggtgttcttcaatatctacagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaatccaccactcagggtctagatggccttggtcagcgttgtgccaagtactacgaagctggtgcacgttttgcca

SEQ ID NO: 1757 - DNA, 238 bp, Glycine max
tctcagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttctgccaagtactacgaagctggtgcacgttttgccaaatggcgtgcagtgctg

SEQ ID NO: 1758 - DNA, 280 bp, Glycine max
tacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaa

SEQ ID NO: 1759 - DNA, 256 bp, Glycine max
ccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggaggctggtgtgcttcctggcatcaaggttgacaagggcacagttgagcttgctggcactaatggagaaaccaccactcagggtctagatggctt

SEQ ID NO: 1760 - DNA, 274 bp, Glycine max
tctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgagg

SEQ ID NO: 1761 - DNA, 250 bp, Glycine max
tggaaagggtattcttgctgctgatgagtcaacagggacaattggcaagcgtttggccagcatcagtgtagagaatcttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggaggctggtgttcttcctggcatcaaggttgac

SEQ ID NO: 1762 - DNA, 256 bp, Glycine max
ccatgatgagcttattgccaatgctgcttacattggcactcctggaaagggtattcttgctgctgatgagtcaacagggacaattggcaagcgtttgccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttga

SEQ ID NO: 1763 - DNA, 295 bp, Glycine max
tctttttcttctctctcaacaacttcaccttcttcctcctcgatcatgtctcacttcaacggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttaggggcgcgcttttcactgctcctggtgttcttcaatatctcagtggtgtcatcctctttgatgaaccctctaccagagcacagc

SEQ ID NO: 1764 - DNA, 269 bp, Glycine max
ctcgagccgcttcttcctcctcgatcatgtctcacttcaagggcaagtaccatgatgagctcatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccag

SEQ ID NO: 1765 - DNA, 252 bp, Glycine max
  unsure (1)..(252): unsure at all n locations
ggcaagtaacatgatgagcttatcgccaatgctgcgtncatnggcactcctgganagggtattcttgctgctgatgagtcaacagggncaattggcaagcgtttggccagnatcagtgtagagnacattgaatccaacaggcgagctcttagggagctgcttttnactgctcctggtgttcttcaatatctcagtggtgtcatcctctttgaggaaaccctctaccagagcacagctgcaggcaagcccttt

SEQ ID NO: 1766 - DNA, 256 bp, Glycine max
ggaggaggcatccgtcaacctcaacgccattaaccaggtcaatgggaagaagccatggtcactctctttctcctttggaagggcacttcaacagagcacccttaaggcatggggcggaaaagaagagaatgtgaagaaggctcaggaagcccttttggtaagagccaaggctaactcagaggcaactctgggaacctacaagggtaactcacagcttgctgatggtgcctcagagagcctccatgtttcgaactac

SEQ ID NO: 1767 - DNA, 261 bp, Glycine max
ctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaacagagcacccttaaggcatggggcggaaaagaagagaatgtgaagaaggctcaggaagcccttttggtaagagcca

SEQ ID NO: 1768 - DNA, 269 bp, Glycine max
attcacaagtgtgccgccgtcaccgagcgtgtccttgcagcatgctacaaggctttgaatgatcaccatgtccttcttgagggtaccctattgaagccaaacatggtcacccctggatcccaatctgctaaggtttcccctcaggtggttgccgagcacactgtcagagcccttcagagaactgtgcctgctgcagttcctgctgtcgttttcttgtctggtggccagagtgaggaggaggcatccgtcaacctcaacgccattaacca

SEQ ID NO: 1769 - DNA, 294 bp, Glycine max
acctacctctttttcttctctctcaacaacttcaccttcttcctcctcgatcatgtctcacttcaagggcaagtaccatgatgagcttatcgccaatgctgcgtacattggctctcctgtgaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaacctctacca

SEQ ID NO: 1770 - DNA, 248 bp, Glycine max
tgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaggactcagggtctagatggccttggtcagcgttgtg

SEQ ID NO: 1771 - DNA, 267 bp, Glycine max
  unsure (1)..(267): unsure at all n locations
tggatctcatgacattcacaagtntgctgccgtcaccgagcgtgtccttgcagcatgctacaaggctttgaatgatcaccacgtccttcttgagggtaccctattgaagccaaacatggtcacccccggatccaattctgctaaggtttcccctcaggtggttgcggagcacactgttagagcccttcagagaaccgtgcctgctgcagttcctgctatcgttttcttgtctggtgggcagagtgaggaggaggcatccgttaacct

SEQ ID NO: 1772 - DNA, 285 bp, Glycine max
ctctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgag

SEQ ID NO: 1773 - DNA, 267 bp, Glycine max
ctgttagagcccttcagagaaccgtgcctgctgcagttcctgctatcgttttcttgtctggtgggcagagtgaggaggaggcatccgttaacctcaatgccattaaccaggtcaatggaaagaagccatggtcactctctttctcctttggaagggcacttcaacagagcacccttaaggcatggagtggaaaagaggagaatgtgaagaaggctcaggaagcccttttggtaagagccaaggccaactcagaggcaactctgggaa

SEQ ID NO: 1774 - DNA, 285 bp, Glycine max
tctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgagg

SEQ ID NO: 1775 - DNA, 284 bp, Glycine max
ctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgagg

SEQ ID NO: 1776 - DNA, 261 bp, Glycine max
  unsure (1)..(261): unsure at all n locations
cagagaaccgtgcctgctgcagttcctgctatcgttttcttgtctngtgggcagagtgaggaggaggcatccgttaacctcaatgccattaaccaggtcaatggaaagaagccatggtcactctctttctcctttggaagggcacttcaacagagcacccttaaggcatggagtggaaaagaggagaatgtgaagaaggctcaggaagcccttttggtaagagccaaggctaactcagaggcaactctgggaactacaagg

SEQ ID NO: 1777 - DNA, 274 bp, Glycine max
  unsure (1)..(274): unsure at all n locations
tgcctncngcagttcctgctatcgttttcttgtctggtgggcagagtgaggaggaggcatccgttaacctcaatgccatnaaccaggtcaatggaaagaagccatggtcactctctttctcctttggaagggcacttcaagnagcacccttaaggcatggagtggaaaagaggagaatgtgaagaaggctcaggaagcccttttggtaagagccaaggccaactcagaggcaactctgggaacctacaagggtaactcaaagcttgctgatggt

SEQ ID NO: 1778 - DNA, 248 bp, Glycine max
gtctcacttcaagggcaagtaccatgatgagcttatcgccaatgctgcgtacattggcactcctggaaccggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacag

SEQ ID NO: 1779 - DNA, 278 bp, Glycine max
aacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctcttt

SEQ ID NO: 1780 - DNA, 271 bp, Glycine max
ctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctcttt

SEQ ID NO: 1781 - DNA, 273 bp, Glycine max
ctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtatagaacattgaatccaacaggcgagctcttagggagctgcttttcactgctcctggtgttcttcaatatctcagtggtgtcatcctctttga

SEQ ID NO: 1782 - DNA, 238 bp, Glycine max
gaatccaacaggcgagctcttagggagctgcttttcactgctcctggtgttcttcaataggtcagtggtgtcatcctctttgaggtaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtc

SEQ ID NO: 1783 - DNA, 258 bp, Glycine max
aacagggacaattggcaagcgtttggccagcatcagtgtagagaatgttgaatccaacaggtgtgctcttagggagctgcttttcaccgctcccggtgctcttaaatatctcagtggtgtcatcctctttgaggaaactctctaccagagcacagctgcaggcaagccctttgtggaagtcttgaaggaggctggtgtgcttcctggcatcaaggttgacaagggcacagttgagcttgctggcactaatggagaaac

SEQ ID NO: 1784 - DNA, 257 bp, Glycine max
attgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaacagagcacccttaaggcatggg

SEQ ID NO: 1785 - DNA, 272 bp, Glycine max
cgagaaccgtgcctgctgcagttcctgctatcgttttcttgtctggtgggcagagtgaggaggaggcatccgttaacctcaatgccattaaccaggtcaatggaaagaagccatggtcactctctttctcctttggaagggcacttcaacagagcacccttaaggcatggagtggaaaagaggagaatgtgaagaaggctcaggaagcccttttggtaagagccaaggccaactcagaggcaactctgggaactacaagggtaatcaaagct

SEQ ID NO: 1786 - DNA, 273 bp, Glycine max
ctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttga

SEQ ID NO: 1787 - DNA, 270 bp, Glycine max
tgacattcacaagtgtgctgccgtcaccgagcgtgtccttgcagcatgctacaaggctttgaatgatcaccacgtccttcttgagggtaccctattgaagccaaacatggtcacccccggatccaattctgctaggtttcccctcaggtggttgcggagacactgttagagcccttcagagaaccgtgcctgctgcagttcctgctatcgttttcttgtctggtgggcagagtgaggaggaggcatccgttaacctcaatgccattaacc

SEQ ID NO: 1788 - DNA, 284 bp, Glycine max
  unsure (1)..(284): unsure at all n locations
gtgcctgctgcagttcctgctatcgttttcttgtctggtgggcagagtgaggnggaggcatccgttaaccctnaangccattaaccaggtcaatggaaagaagccatggtcactctctttctcctttggaagggcacttcaacagagcacccttaaggcatggagtggaaaagaggagaatgtgaagaaggctcaggaagcccttttggtaagagccaaggccaactnagaggcaactctgggaacctacaagggnaatcaaagcntgctgatggtgcctcaga

SEQ ID NO: 1789 - DNA, 268 bp, Glycine max
  unsure (1)..(268): unsure at all n locations
cttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggacagnnctttgtgaatgtcttgaaggaagctggtgtgcttcctggcatcaaggttgacaagggcacagtcgagcttgctggaactaatg

SEQ ID NO: 1790 - DNA, 260 bp, Glycine max
ggttgacggatgcctcctcctcaacgccattaaccaggtcaatgggaagaagccatggtcactctctttctcctttggaagggcacttcaacagagcacccttaaggcatggggcggaaaagaagagaatgtgaagaaggctcaggaagcccttttggtaagagccaaggctaactcagaggcaactctgggaacctacaagggtaactcacagcttgctgatggtgcctcagagagcctccatgtttcgaactacagct

SEQ ID NO: 1791 - DNA, 264 bp, Glycine max
caacctacccctttttcttctcccaccaacttcaccgtcttcttcctcgatcatgtctcacttcaagggcaagtaccatgatgagcttattgtcaatgctgcttacattggcactcctggaaagggtattcttgctgctgatgagtcaacagggacaattgcaagcgtttggccagcatcagtgtagagaatgttgaatccaacaggcgtgctcttagggagctgcttttcaccgctcccggtgctcttaaatatctcagtggt

SEQ ID NO: 1792 - DNA, 260 bp, Glycine max
ctctctcaacaacttcaccttcttcctcctcgatcatgtcttacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctcttt

SEQ ID NO: 1793 - DNA, 251 bp, Glycine max
  unsure (1)..(251): unsure at all n locations
ggaggaggcatccgtcaacctcaacgccattnaccaggtcaatgggaagaagccatggtcactctctttctcctttggaagggcacntcaacagagcacccttaaggcntggggcggaaaagaagagaatgtgaagaaggctcaggaagcccttttggtaagagccaaggctaactcagaggcaactctgggaacctacaagggtaactcacagcttgctgatggtgcctcagagagcctccatgtttcga

SEQ ID NO: 1794 - DNA, 286 bp, Glycine max
ctctcaagtccaacctacccctttttcttctcccaccaacttcaccgtcttcttcctcgatcatgtctcacttcaagggcaagtaccatgatgagcttattgtcaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctt

SEQ ID NO: 1795 - DNA, 251 bp, Glycine max
gaatgcctatggcttggccagatacgctgtcatatgccaggagaatggcctggttcccattgttgagcctgagatccttgttgatggatctcatgacattcacaagtgtgctgccgtcaccgagcgtgtccttgcagcatgctacaaggctttgaatgatcaccacgtccttcttgagggtaccctattgaagccaaacatggtcacccccggatccaattctgctaaggtttcccctcaggtggttgcgg

SEQ ID NO: 1796 - DNA, 294 bp, Glycine max
  unsure (1)..(294): unsure at all n locations
cnaacctctcaagtccaacctacccctttttnttctcccaccaacttcaccgttcnnttcctcgatcatgtctcacttcaagggcaagtaccatgatgagcttattgtcaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttga

SEQ ID NO: 1797 - DNA, 300 bp, Glycine max
tcggcattcggctcgatctcaagtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctct

SEQ ID NO: 1798 - DNA, 294 bp, Glycine max
tgacgacagaaggggttgccgagcacactgtcagagcccttcagagaaccgtgcctgctgcagttcctgctgtcgttttcttgtctggtggccagagtgaggaggatgcatccgtcaacctcaacgccattaaccaggtcaatgggaagaagccatggtcactctctttctcctttggaagggcacttcaacagagcacccttaaggcatggggcggaaaagaagagaatgtgaagaaggctcaggaagcccttttggtaagagccaaggctaactcagaggcaactctgggaa

SEQ ID NO: 1799 - DNA, 242 bp, Glycine max
ctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagc

SEQ ID NO: 1800 - DNA, 269 bp, Glycine max
cacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttacatatctcagtggtgtcat

SEQ ID NO: 1801 - DNA, 230 bp, Glycine max
ctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaacagagcacccttaaggcatggggcggaaaagaagagaatgtgaag

SEQ ID NO: 1802 - DNA, 246 bp, Glycine max
atacgctgtcatatgccaggagaatggcctggttcccattgttgagcctgagatccttgttgatggacctcatgacattcacaagtgtgccgccgtcaccgagcgtgtccttgcagcatgctacaaggctttgaatgatcaccatgtccttcttgagggtaccctattgaagccatacatggtcacccctggatcccaatctgctaaggtttcccctcaggtggttgccgagcacactgtcagagc

SEQ ID NO: 1803 - DNA, 262 bp, Glycine max
ctacaaggctttgaatgatcaccatgtccttcttgagggtaccctattgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcc

SEQ ID NO: 1804 - DNA, 280 bp, Glycine max
tctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgttggccagcatcagtgtagagcccattgaatccaacaggcgagctcttagggagctgcttttcactgctcctggtgttcttcaatatctcagtggtgtcatcctctttgaggaaaccctctaccagagca

SEQ ID NO: 1805 - DNA, 294 bp, Glycine max
caacctctcaagtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgtgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgagg

SEQ ID NO: 1806 - DNA, 290 bp, Glycine max
  unsure (1)..(290): unsure at all n locations
tctaacctacctctttttcttctctctcaacaacttcaccttcttcctcctcgatcatgtctncacttccaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaa

SEQ ID NO: 1807 - DNA, 266 bp, Glycine max
acctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtg

SEQ ID NO: 1808 - DNA, 258 bp, Glycine max
ctgagctggctatccatgagaatgcctatggcttggccagatacgctgtcatatgccaggagaatggcctggttcccattgttgagcctgagatccttgttgatggatctcatgacattcacaagtgtgctgccgtcaccgagcgtgtccttgcagcatgctacaaggctttgaatgatcaccacgtccttcttgagggtaccctattgaagccaaacatggtcacccccggatccaattctgctaaggtttcccctc

SEQ ID NO: 1809 - DNA, 279 bp, Glycine max
  unsure (1)..(279): unsure at all n locations
aacctctaacctacctctttttcttctctctcaacaacttcaccttcttcctcctcgatcatgtctcacttcaagggcaagtaccatgatgagcttatcgccaatgctgcgtacattggcactcctggaaagggtattctngctgctgatgagtcaacagggacaattggcaagcgtttggccagcatcagtgtagagaacattgaatccaacaggcgagctcttagggagctgcttttcactgctcctggtgttcttcaatatctcagtggtgtcatc

SEQ ID NO: 1810 - DNA, 244 bp, Glycine max
attgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaacagagcacc

SEQ ID NO: 1811 - DNA, 264 bp, Glycine max
cctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtca

SEQ ID NO: 1812 - DNA, 269 bp, Glycine max
aacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtc

SEQ ID NO: 1813 - DNA, 268 bp, Glycine max
  unsure (1)..(268): unsure at all n locations
cctctttttcttctctctcaacaacttcaccttcntcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcct

SEQ ID NO: 1814 - DNA, 271 bp, Glycine max
aacctacctctttttcttctctctcaacaacttcaccttcttcctcctcgatcatgtctcacttcaagggcaagtaccatgatgagcttatcgccaatgctgcgtacattggcactcctggaaagcgtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcat

SEQ ID NO: 1815 - DNA, 265 bp, Glycine max
gatcaccatgtccttcttgagggtaccctattgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaac

SEQ ID NO: 1816 - DNA, 251 bp, Glycine max
ctgctcctggtgttcttcaatatctcagttctgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttgtgccaagtactacgaagctggtgcacgttttgccaaatggcgt

SEQ ID NO: 1817 - DNA, 265 bp, Glycine max
gctcgaagcgcaattggacaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccacc

SEQ ID NO: 1818 - DNA, 264 bp, Glycine max
tctcgagccgattcggctcgaggtgcctgctgcagttcctgctgacgttttcttgtctggaggccagagtgaggaggagacatccgtcaacctcaacgccattaaccaggtcaatgggaagaagccatggtcactctctttctcctttggaagggcacttcaacagagcacccttaaggcatggggcggaaaagaagagaatgtgaagaatgctcaggaagcccttttggtaagagccaaggctaactcagaggcaactctggg

SEQ ID NO: 1819 - DNA, 247 bp, Glycine max
  unsure (1)..(247): unsure at all n locations
ctctcaacaacttcaccttcttcctcctcgatcatgtctcacttcaagggcaagtaccatgatgagcttatcgccaatgctgcgtacattggcactcctggaaagggnattcttgctgctgatgagtcaacagggacaattggcaagcgtttggccagcatcagtgtagagaacattgaatccaacaggcgagctcttagggagctgcttttcactgctcctggtgttcttcaatatctcagtggtg

SEQ ID NO: 1820 - DNA, 241 bp, Glycine max
attgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaacagagc

SEQ ID NO: 1821 - DNA, 267 bp, Glycine max
  unsure (1)..(267): unsure at all n locations
aacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcntcaatatctcagtggtg

SEQ ID NO: 1822 - DNA, 268 bp, Glycine max
gtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggt

SEQ ID NO: 1823 - DNA, 266 bp, Glycine max
taacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtgg

SEQ ID NO: 1824 - DNA, 259 bp, Glycine max
ctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggt

SEQ ID NO: 1825 - DNA, 249 bp, Glycine max
tcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatc

SEQ ID NO: 1826 - DNA, 272 bp, Glycine max
cgaagctggtgcacgttttgccaaatggcgtgcagtgctgaagattggtcccaacgagccatctgagctgtctatccatgagaacgcctatggcttggctagatacgctgtcatatgccaggagaatggcctggttcccattgttgagcctgagatccttgttgatggacctcatgacattcacaagtgtgccgccgtcaccgagcgtgtccttgcagcatgctacaaggctttgaatgatcaccatgtccttcttgagggtaccctattga

SEQ ID NO: 1827 - DNA, 253 bp, Glycine max
gaacattgaatccaacaggcgagctcttagggagctgcttttcactgctcctggtgttcttcaatatctcagtggtgtcatcctctttgaggaaaccctctaccagagcacagctgcaggcaagcccttgtgaatgtcttgaaggaagctggtgtgcttcctggcatcaaggttgacaagggcacagtcgagcttgctggaactaatggagacaccaccactcagggtctagcatggcttagtcagcgttgtg

SEQ ID NO: 1828 - DNA, 258 bp, Glycine max
ctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctca

SEQ ID NO: 1829 - DNA, 248 bp, Glycine max
gccaggagaatggcctggttcccattgttgagcctgaggtccttgttgatggacctcgtgacattcacaagtgtgccgccgtcaccgagcgtgtccttgcagcatgctacaaggctttgggtgatcaccgtgtccttcttgagggtaccctattgaagccaaacatggtcacccctggatcccagtctgctaaggtttcccctcaggtggttgccgagcacactgtcagagcccttcagagaaccgtg

SEQ ID NO: 1830 - DNA, 237 bp, Glycine max
attgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaaca

SEQ ID NO: 1831 - DNA, 248 bp, Glycine max
cttgagggtacctattgaagccaaacatggtcacccccggatccaattctgctaaggtttcccctcaggtggttgcggacacactgttagagcccttcagagaaccgtgcctgctgcagttcctgctatcgttttcttgtctggtgggcagagtgaggaggaggcatccgttaacctcaatgccattaaccaggtcaatggaaagaagccatggtcactctctttctcctttggaagggcacttcaac

SEQ ID NO: 1832 - DNA, 252 bp, Glycine max
agtcggatctagctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagtacagctgcaggcaacccctttgtggaactcttgaaggagg

SEQ ID NO: 1833 - DNA, 264 bp, Glycine max
ctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcag

SEQ ID NO: 1834 - DNA, 253 bp, Glycine max
gccgtcaccgagcgtgtccttgcagcatgctacaaggctttgaatgatcaccatgtccttcttgagggtaccctattgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaacc

SEQ ID NO: 1835 - DNA, 280 bp, Glycine max
ctcaagtccaacctacccctttttcttctcccaccaacttcaccgtcttcttcctcgatcatgtctcacttcaagggcaagtaccatgatgagcttattgccaatgctgcttacattggcactcctggaaagggtattcttctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcct

SEQ ID NO: 1836 - DNA, 258 bp, Glycine max
ctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtg

SEQ ID NO: 1837 - DNA, 242 bp, Glycine max
acttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcat

SEQ ID NO: 1838 - DNA, 252 bp, Glycine max
cctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatc

SEQ ID NO: 1839 - DNA, 272 bp, Glycine max
  unsure (1)..(272): unsure at all n locations
acctacctctttntcttctctctcaacaacttcancttcttcctcctcgatcatgtctcacttcaagggcaagtaccatgatgagcttatcgncaatgctgcgtacattggcactcctggaaagggtattcttgctgctgatgagtcaacagggacaattggcaagcgtttggccagcatcagtgtagagaacattgaatccaacaggcgagctcttagggagctgctttncactgctcctggtgntcttcaatatctcaggtgtcatcctc

SEQ ID NO: 1840 - DNA, 246 bp, Glycine max
atcaccatgtccttcttgagggtaccctattgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcct

SEQ ID NO: 1841 - DNA, 252 bp, Glycine max
ctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatct

SEQ ID NO: 1842 - DNA, 251 bp, Glycine max
ctttttcttctctctcaacaacttcaccttcttcctactcgatcatgtctcacttcaagggcaagtaccatgatgagcttattgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctc

SEQ ID NO: 1843 - DNA, 266 bp, Glycine max
  unsure (1)..(266): unsure at all n locations
ccctttttnttctcccaccaacttcnccgtcttcttcctcgatcatgtctcacttaaagggcaagtaccatgatgagcttnttgccaatgctgcttacnttggcactcctggaaagggtattcttgctgctgntgagtcaacanggacaattggcaagcgtttggccagcatcagtgtanagaatgttgantccaacaggcgtgctcttagggagctgcttttcnccgctcccggtgctcttaaatatctcagtggtgtcatcctc

SEQ ID NO: 1844 - DNA, 258 bp, Glycine max
ctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccagcaggcgagctcttagggagctgcttttcactgctcctggtgttcattcatatctcagggtgt

SEQ ID NO: 1845 - DNA, 265 bp, Glycine max
caagtccaacctacccctttttcttctcccaccaacttcaccgtcttcttcctcgatcatgtctcacttcaagggcaagtaccatgatgagcttattgtcaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctc

SEQ ID NO: 1846 - DNA, 278 bp, Glycine max
ttccaacctctcaagtccaacctacccctttttcttctcccaccaacttcaccgtcttcttcctcgatcatgtctcacttcaagggcaagtaccatgatgagcttattgccaatgctgcttacattggcactcctggaaagggtttcttgctgctgatgagtcaacagggacaattggcaagcgtttggccagcatcagtgtagagaatgttgaatccaacaggcgtgctcttagggagctgcttttcaccgctcccggtgctcttaaatatctcagt

SEQ ID NO: 1847 - DNA, 277 bp, Glycine max
tcaagtccaacctacccctttttcttctcccaccaacttcaccgtcttcttcctcgatcatgtctcacttcaagggcaagtaccatgatgagcttattgtcaatgctgcttacattggcactcctggatcagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtca

SEQ ID NO: 1848 - DNA, 224 bp, Glycine max
cgggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttctggaagtcttgaaggaggctggtgtg

SEQ ID NO: 1849 - DNA, 238 bp, Glycine max
ctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctc

SEQ ID NO: 1850 - DNA, 265 bp, Glycine max
ctcaagtccaacctacccctttttcttctcccaccaacttcaccgtcttcttcctcgatcatgtctcacttcaagggcaagtaccatgatgagcttattgccaatgatacttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatc

SEQ ID NO: 1851 - DNA, 271 bp, Glycine max
acctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatattcagtggtgtcatcc

SEQ ID NO: 1852 - DNA, 261 bp, Glycine max
gtcaccgagcgtgtccttgcagcatgctacaaggctttgaatgatcaccatgtccttcttgagggtaccctattgaagccaaacatggtcaccctggatcccaatctgctaaggtttcccctcaggtggttgcgagcacactgtcagagcccttcagagaaccgtgcctgctgcagttcctgctgtcgttttcttgtctggtggccagagtgaggaggaggcatccgtcaacctcaacgccattaaccagtcaatgggaag

SEQ ID NO: 1853 - DNA, 261 bp, Glycine max
  unsure (1)..(261): unsure at all n locations
caacctctcaagtccaacctacccctttttcttctcccaccaacttcaccgtcntcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgct

SEQ ID NO: 1854 - DNA, 240 bp, Glycine max
ctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaatattgaatccaacaggcgagctcttagggagctgcttttcactgctcctggtcttcttcaatatc

SEQ ID NO: 1855 - DNA, 234 bp, Glycine max
gagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagaggacagctgcaggcaagccctttgtgaatgtcttgaaggaagctggtgtgcttcctggcatcaaggttgacaagggcaca

SEQ ID NO: 1856 - DNA, 261 bp, Glycine max
ctcaagtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaa

SEQ ID NO: 1857 - DNA, 260 bp, Glycine max
ctcaagtccaacctacccctttttcttctcccaccaacttcaccgtcatcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaa

SEQ ID NO: 1858 - DNA, 242 bp, Glycine max
  unsure (1)..(242): unsure at all n locations
cgtcaccgagcgtgtccttgcagcatgctacaaggctttgaatgatcaccatgtccttcttgagggtaccctattgaagccaaacatggtcacccctggatcccaatctgcnaaggtttcccctcaggtggttgccgagcacactgtcagagcccttcagagaaccgtgcctgctgcagttcctgctgtcgntttcttgtctggtggccagagtgaggaggaggcatccgtcaacctcaacg

SEQ ID NO: 1859 - DNA, 266 bp, Glycine max
cctacctctttttcttctctctcaacaacttcaccttcttcctcctcgattcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtg

SEQ ID NO: 1860 - DNA, 260 bp, Glycine max
ctttcttctctctcaacaacttcaccttcctcctcctcgatcatgtctcacttcaacggcaagtaccatgatgagcttatcgccaatgctgcgtacattggcactcctggaaagggtactcttgctgctgatgagcaacagggacaattggcaagcgtttggccagcatcagtgtagagaaccttgaatccaacaggcgagctcttagggagctgcttttcactgctcctggtgttcttcaatatctcagtggtgtcatc

SEQ ID NO: 1861 - DNA, 264 bp, Glycine max
ctctaacctacctctttttcttctctctcaacaacttcaccttcttcctcctcgatcatgtctcacttcaagggcaagtaccatgatgagcttatcgccaatgctgcgtacattggcactcctggaaagggtattttgctgctgatgagtcaacagggacaattggcaagcgtttggccagcatcagtgtagagaacattgaatccaacaggcgagctcttagggagctgcttttcactgctcctggtgttcttcaatatctca

SEQ ID NO: 1862 - DNA, 256 bp, Glycine max
gtccaacctacccctttttcttctcccaccaacttcaccgtagacttcctcgatcatgtctcacttcaagggcaagtaccatgatgagcttattgccaatgctgcttacattggcactcctggaaagggtattcctgctgctgatgagtcaacagggacaattggcaagcgtttggccagcatcagtgtagagaatgttgaatccaacaggcgtgctcttagggagctgcttttcaccgctcccggtgctcttaaa

SEQ ID NO: 1863 - DNA, 256 bp, Glycine max
cctacctctttttcttctctctcaacaacttcaccttcttcctcctcgatcatgtctcacttcaagggcaagtaccatgatgagcttatcgccaatgctgcgtacattggcactcctggaaagggtattcttctgctgatgagtcaacagggacaattggcaagcgtttggccagcatcagtgtagagaacattgaatccaacaggcgagctcttagggagctgcttttcactgctcctggtgttcttcaatatct

SEQ ID NO: 1864 - DNA, 247 bp, Glycine max
ccgtcaccgagcgtgtccttgcagcatgctacaaggctttgaatgatcaccacgtccttcttgagggtaccctattgaagccaaacatggtcacccccggatccaattctgctaaggtttcccctcaggtggttgcggagacactgttagagcccttcagagaaccgtgcctgctgcagttcctgctatcgttttcttgtctggtgggcagagtgaggaggaggcatccgttaacctcaatgccatt

SEQ ID NO: 1865 - DNA, 256 bp, Glycine max
gctgtgtttttaattgatggatttgcttgcagatccgcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcatggtgtcatcctctttgaggaaaccctctaccagagcacagctg

SEQ ID NO: 1866 - DNA, 266 bp, Glycine max
gaagggcacttcaacagagcacccttaaggcatggagtggaaaagaggagaatgtgaagaaggctcaggaagcccttttggtaagagccaaggccaactcagaggcaactctgggaacctacaagggtaactcaaagcttgctgatggtgcctcagagagcctccatgttgaggactacaagtactgatcaatctaagtgcgggtaggaatcggtattttatgggtacaaccgaattttcttgttaatgagtattgtgcttcgact

SEQ ID NO: 1867 - DNA, 247 bp, Glycine max
ctctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctg

SEQ ID NO: 1868 - DNA, 264 bp, Glycine max
  unsure (1)..(264): unsure at all n locations
ctacctctttttcttctctctcaacaacttcaccttcttcctccncgatcatgtctncacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggt

SEQ ID NO: 1869 - DNA, 269 bp, Glycine max
ctcaagtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctaccggtgctcttaaatatctcag

SEQ ID NO: 1870 - DNA, 250 bp, Glycine max
cctcgagctcgattcggctcgagggccaagtaccatgatgagcttacgcgccaatgctgcgaccattggcactcctggaaagggtattcttgctgctgatgagtcaacagggacaattggctcgcgtttggccagcatcagtgtagagaacattgaatccaacaggcgagctcttagggagctgcttttcactgctcctggtgttcttcaatatctcagtggtgtcatcctctttgaggaaaccctctac

SEQ ID NO: 1871 - DNA, 259 bp, Glycine max
ctcaagtccaacctacccctttttcttctcccaccaacttcaccgtcttcttcctcgatcatctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaa

SEQ ID NO: 1872 - DNA, 249 bp, Glycine max
ccaacctacccctttttcttctcccaccaacttcaccgtcatcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttatcaccgctcccggtgctc

SEQ ID NO: 1873 - DNA, 243 bp, Glycine max
ctcaagtccaacctacccctttttcttctcccaccaacttcaccgtcttcttcctcgatcatgtctcacttcaagggcaagtaccatgatgagcttattgtcaatgctgcttacattggcactcctggaaagggtattcttgctgctgatgagtcaacagggacaattggcaagcgtatggctcgcatcagtgtagagaatgttgaatccaacaggcgtgctcttagggagctgcttttcacc

SEQ ID NO: 1874 - DNA, 254 bp, Glycine max
  unsure (1)..(254): unsure at all n locations
acctctcaagtccaacctacccctttttcttctcccaccancttcnccgtcttcttcctcgatcatgtctcacttcaagggcaagtaccatgatnagcttattgccaatgctgcntncattggcactcctggaaagggtattcttgctgctgatgagtcaacagggncaattggcaagcgtttggccagcatcngtgtaganaatgttgaatccnacaggcgtgctcttagggagctgcttttcaccgctcccg

SEQ ID NO: 1875 - DNA, 252 bp, Glycine max
aacctacctctttttcttctctctcaacaacttcacctacttcctcctcgatcatgtctcacttcaagggcaagtaccatgatgagcttatcgccaatgctgcgtacattggcactcctggaaagggcattcttgctgctgaggagtcaacagggacaattggcaagcgtttggccagcatcagtgtcgagaacattgaatccaacaggcgagctcttagggagctgcttttcactgctcctggtgttcccc

SEQ ID NO: 1876 - DNA, 294 bp, Glycine max
caacctctcaagtccaacctacccctttttcttctcccaccaacttcaccgtcttcttcctcgattcatgtctcacttcaaggggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcaacctcttga

SEQ ID NO: 1877 - DNA, 244 bp, Glycine max
tcaagtattaacccttttctctctgaatactctctactcaatacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgc

SEQ ID NO: 1878 - DNA, 244 bp, Glycine max
ctcaagtccaacctacccctttttcttctcccaccaacttcaccgtcctcttcctcgatcatgtctcacttcaagggcaagtaccatgatgagcttattgtcaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccg

SEQ ID NO: 1879 - DNA, 259 bp, Glycine max
ccaacctctcaagtccaacctacccctttttcttctcccaccaacttcaccgtcttcttcctcgatcatgtctcacttcaagggcaagtaccatgatgagcttattgtcaatgctgcttacattggcactctggaaagggtattcttgctgctgatgagtcaacagggacaattggcaagcgtttggccagcatcagtgtagagaatgttgaatccaacaggcgtgctcttagggagctgcttttcaccgctcccggtg

SEQ ID NO: 1880 - DNA, 258 bp, Glycine max
gtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaata

SEQ ID NO: 1881 - DNA, 268 bp, Glycine max
tctcgagccgattcggctcgaggtgcctgctgcagttcctgctgacgttttcttgtctggtggccagagtgaggaggaggacatccgtcaacctcaacgccattaaccaggtcaatgggaagaagccatggtcactctctttctcctttggaagggcacttcaacagagcacccttaaggcatggggcggaaaagaagagaatgtgaagaaggctcaggaagcccttttggtaagagccaaggctaactcagaggcaactctgggaac

SEQ ID NO: 1882 - DNA, 251 bp, Glycine max
cttttcttctctctcaacaacttcaccttcgtccacctcgatcatgtctcacttcaagggcaagtaccatgatgagcttatcgccaatgctgcgtacattggcactcctggaaagggtattcttgctgctatgagtcaacagggacaattggcaagcgtttggccagcatcagtgtagagaacattgaatccaacaggcgagctcttagggagctgcttttcactgctcctggtgttcttcaatatctcag

SEQ ID NO: 1883 - DNA, 239 bp, Glycine max
caggtgagttcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttgtg

SEQ ID NO: 1884 - DNA, 261 bp, Glycine max
  unsure (1)..(261): unsure at all n locations
ctaacctacctctttttcttttctctcaacaacttcacnttcttcctcctcgatcatgtctnacttncaagggcaagtaccatgatgagcttatcgccaatgctgcgtacattggcactcctggaaagggtattcttgtgctgatgagtcaacagggacaattggcaagcgtttggccagcatcagtgtagagaacattgaatccaacaggcgagctcttagggagctgcttttcactgctcctggtgttcttcaatatct

SEQ ID NO: 1885 - DNA, 239 bp, Glycine max
ccaacctctcaagtccaacctacccctttttcttctcccaccaacttcaccgtcctcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagc

SEQ ID NO: 1886 - DNA, 256 bp, Glycine max
  unsure (1)..(256): unsure at all n locations
ctttcttccaacctctcaagtccacactacccctttttcttctcccaccaacttcaccgatcacntcntcgatcatgtctcacttcaagggcaagtaccatgatgagcttattgtcaatgctgcttacattggcactcctggaaagggtattcttgctgctgatgagtcaacagggacaattggcaagcgtttggccagcatcagtgtagagaatgttgaatccaacaggcgtgctcttagggagctgcttttcac

SEQ ID NO: 1887 - DNA, 264 bp, Glycine max
acctacctctttttcttctctctcaacaacttcaccttcttcctcctcgatcatgtctcacttcaagggcaagtaccatgatgagcttatcgccaatgctgcgtacattggcactcctggacagggtattcttgctgctgatgagtcaacagggacaattggcaagcgtttggccagcatcagtgtagagaacattgaatccaacaggcgagctcttagggagctgcttttcactgctcctggtgttcttcaatatctcagtgg

SEQ ID NO: 1888 - DNA, 255 bp, Glycine max
ctaacctacctctttttcttctctctcaacaacttcaccttcttcctcctcgatcatgtctcacttcaagggcaagtaccatgatgagcttatcgccaatgctgcgtacattggcactcctggaaagggtattttgctgctgatgagtcaacagggacaattggcaagcgtttggccagcatcagtgtagagaacattgaatccaacaggcgagctcttagggagctgcttttcactgctcctggtgttcttcaa

SEQ ID NO: 1889 - DNA, 254 bp, Glycine max
  unsure (1)..(254): unsure at all n locations
ctttcttccaacctctcaagtccaacctacccctttttcttctcncaccaacttcaccgtcttcttcctcgatcatgtctcacttcaagggcaagtaccatgatgagcttattgccaatgctgcttacattgcactcctggaaagggtattcttgctgctgatgagtcaacagggacaattggcaagcgtttggccagcatcagtgtagagaatgttgaatccaacaggcgtgctcttagggagctgcttttca

SEQ ID NO: 1890 - DNA, 255 bp, Glycine max
cctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatat

SEQ ID NO: 1891 - DNA, 238 bp, Glycine max
cctcgagccgaatcggctcgagcacttcaagggcaagtaccatgacgagcttattgtcaaacctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctc

SEQ ID NO: 1892 - DNA, 271 bp, Glycine max
  unsure (1)..(271): unsure at all n locations
ggcctggttcccattgttgagcctgagatccttgttgatggacctcatgacattcacaagtgtgccgccgtcaccgagcgtgtccttgcagcatgctacaaggctttgaatgatcaccatgtccttcttgagggtaccctattgaagccaaacatggtcacccctggatcccaatctgctaaggtttcccctcaggtggttgccgagcaaatgtcagagccttcagagaacggtgcctgctgcagtcctgngtcgttttctggnngggggg

SEQ ID NO: 1893 - DNA, 283 bp, Glycine max
ctctaacctacctctttttcttctctctcaacaacttcaccttctacctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacatcgaatccaacaggcgagctcttagggagctgcttttcactgctcctggtgttcttcaatatctcagtactgtcatcctctttg

SEQ ID NO: 1894 - DNA, 253 bp, Glycine max
tttcttccaacctctcaagtccaacctacccctttttcttctcccaccaacttcaccgtcactcttcctcgatcatgtctcacttcaagggcaagtaccatgatgagcttattgccaatgctgcttacattggcactcctggaaagggtattcttgctgctgatgagtcaacagggacaaccggcaagcgtttggccagcatcagtgtagagaatgttgaatccaacaggcgtgctcttagggagctgctttt

SEQ ID NO: 1895 - DNA, 242 bp, Glycine max
ctttcttccaacctctcaagtccatcctacccctttttcttctcccaccaacttcaccgtacacttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagg

SEQ ID NO: 1896 - DNA, 257 bp, Glycine max
  unsure (1)..(257): unsure at all n locations
ctctaacctacctctttntcttctctctcaacaacttcaccttcttcctcctncgatcatgtctccacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttctt

SEQ ID NO: 1897 - DNA, 248 bp, Glycine max
  unsure (1)..(248): unsure at all n locations
cttccaacctctcaagtccaacctaccnctttttcttctcccaccaacttcaccgtccttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctctagggagctgcttt

SEQ ID NO: 1898 - DNA, 243 bp, Glycine max
cttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatc

SEQ ID NO: 1899 - DNA, 268 bp, Glycine max
gccattaaccaggtcaatggaaagaagccatggtcactctctttctcctttggaagggcacttcaacagagcacccttaaggcatggagtggaaaagaggagaatgtgaagaaggctcaggaagcccttttggtaagagccaaggccaactcagaggcaactctgggaacctacaagggtaacttcaaagcttgctgatggtgcctcagagagcctccagttgaggactacaattactgattcaatctaagtgcgggtaggaatcggt

SEQ ID NO: 1900 - DNA, 253 bp, Glycine max
tgctgatgagtcaacagggacaattggcaagcgtttggccagcatcagtgtagagaatgttgaatccaacaggcgtgctcttagggagctgcttttcaccgctcccggtgctcgtaaatatctcagtggtgtcatcctctttaaggaaactctctaccagagcacagctgcaggcaagccctttgtggaagtcttgaatgaggctggtgttcttcctggcatcaaggtttacagggcacagtttcgcttgctg

SEQ ID NO: 1901 - DNA, 228 bp, Glycine max
cggctcgagggtcacccccggatccaattctgctaaggtttcccctcaggtggttgcggagacactgttagagcccttcagagaaccgtgcctgctgcagttcctgctatcgttttcttgtctggtgggcagagtgaggaggaggcatccgttaacctcaatgccattaaccaggtcaatggaaagaagccatggtcactctctttctcctttggaagggcacttcaa

SEQ ID NO: 1902 - DNA, 252 bp, Glycine max
caacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttg

SEQ ID NO: 1903 - DNA, 245 bp, Glycine max
tttcttccaacctctcaagtccaacctacccctttttcttctcccaccaacttcaccgtctacttcctcgatcatgtctcacttcaagggcaagtaccatgatgagcttattgccaatgctgcttacttggcactcctggaaagggtattcttgctgctgatgagtcaacagggacaattggcaagcgtttggccagcatcagtgtagagaatgttgaatccaacaggcgtgctcttagggagct

SEQ ID NO: 1904 - DNA, 255 bp, Glycine max
atcatgtctcacttcaagggcaagtaccatgatgagcttatcgccaatgctgcgtacattggcactcctggaaagggtattcttgctgctgatgagtcaacagggacaattggcaagcgtatgccagcatcagtgtagagaacattgaatccaacaggcgagctcttagggagctgcttttcactgctccgggtgttcttcaatatctcagtggtgtcatcctctttgaggaaaccctctaccagagcacagctg

SEQ ID NO: 1905 - DNA, 233 bp, Glycine max
caacctctcaagtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttagccagcatcagtgtagagaatgttgaatccaacaggcgtgctcttag

SEQ ID NO: 1906 - DNA, 237 bp, Glycine max
ctttttcttctctctcaacaacttcaccttcttcctcctcgcatccgtctcacttcaagggcaagtaccatgatgagcttatcgccaatgctgcgtacattggcactcctggaaagggtattcttgaagctgatgagtcaacagggacaattggcaagcgtttggccagcatcagtgtagagaacattgaatccaacaggcgagctcttagggagctgcttttcactgctcctggtg

SEQ ID NO: 1907 - DNA, 237 bp, Glycine max
tctcgagccgattcggctcgagctaacctacctctttttcttctctcgcaacaacttcacctacttcctcctcgatcatgtcacacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgag

SEQ ID NO: 1908 - DNA, 243 bp, Glycine max
ctcctttggaagggcacttcaacagagcacccttaaggcatggggcggaaaataagagaatgtgaagaaggctcaggaagcccttttggtaagagccaaggctaactcagaggcaactctgggaccctacaagggtaactcacagcttgctgatggtgcctcagagagcctccatgtttcgaactacagctactgatcaatcgaagttggtgttgtttgaagagactagtgcgagtaggaatc

SEQ ID NO: 1909 - DNA, 249 bp, Glycine max
  unsure (1)..(249): unsure at all n locations
ctttcttccaacctctcaagtccaacctacccctttttcttctcncaccancttcaccgtcntcttcctcgancatgtctcacttcaagggcaagtaccatgtgagcttattgccaatgcnncttacattggcactcctggaaagggtattcttgctgctgatgagtcaacagggacaattggcaagcgtttggccagcatcagtgtagagaatgaatccaacaggcgtgctcttagggagctgctttt

SEQ ID NO: 1910 - DNA, 242 bp, Glycine max
cctctaacctacctctttagcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattcaatccaacaggcgagcttagggagctgcttttcactgct

SEQ ID NO: 1911 - DNA, 248 bp, Glycine max
  unsure (1)..(248): unsure at all n locations
cnttggaagggcacttcaacagagcacccttaaggcatgggacngaaaagaagagaatgtgaagnaggctcaggaagccctnntggtaagagccaaggctaactcanaggcaactctgggaacctacaagggtaactcacagcttgctgatggtgcctcagagagcctccatgtttcgaactaagctactgatcaatcgaagttggtgttgtttgaagagnctagtgcgagtaggaatcggtattatg

SEQ ID NO: 1912 - DNA, 243 bp, Glycine max
ctcctttggaagggcacttcaacagagcacccttaaggcatgaggcggaaaagaagagaatgtgaagaaggctcaggaagcccttttggtaagagccaaggctaactcagaggcaactctgggaacctacaagggtaactcacagcttgctgatggtgcctcagagagcctccatgtttcgaactacagctattgtcaatcgagttgggggtggtttaagagacctagttcgagtaggaatcg

SEQ ID NO: 1913 - DNA, 261 bp, Glycine max
gaagaaggctcaggaagcccttttggtaagagccaaggccaactcagaggcaactctgggaacctacaagggtaactcaaagcttgctgatggtgcctcagagagcctccatgttgaggactacaagtactgatcaatctaagtgcgggtaggaatcggtattttatgggtacaaccgaattttcttgttaatgagtattgtgcttcgactcttcccagaataataatcgtttggaattttgctttttgtttttcctagtg

SEQ ID NO: 1914 - DNA, 253 bp, Glycine max
cggctcgagcggctcgagcggctcgagaacctacctctttttcttctctctcaacaacttcaccttcttccacctcgataatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagct

SEQ ID NO: 1915 - DNA, 260 bp, Glycine max
aacagagcacccttaaggcatggggcggaaaagaagagaatgtgaagaaggctcaggaagcccttttggtaagagccaaggctaactcagaggcaactctgggaacctacaagggtaactcacagcttgctgatggtgcctcagagagcctccatgtttcgaactacagctactgatcaatcgaagttggtgttgtttgaagagactagtgcgagtaggaatcggtattatgggtacaacaaccgaatttcttgttgata

SEQ ID NO: 1916 - DNA, 257 bp, Glycine max
  unsure (1)..(257): unsure at all n locations
aagcaacctctaacctacctctttttcttctctctcaacaacttcaccttcttcactctcgatcatgacacacntcaaaggcaagtaccatgatgagcttatcgccaatgctgcgtacattggcactcctggaaagggcattcttgctgctgatgagtcaacagggacaattggcaagcgtttggccagcatcagtgtagagaacattgaatccacaggcgagctcttagggagctgcttttcactgctcctggtgt

SEQ ID NO: 1917 - DNA, 263 bp, Glycine max
  unsure (1)..(263): unsure at all n locations
ggagaatgtgaagaaggctcaggaagcccttttggtaagagccaaggccaactcagaggcaactctgggaacctacaagggtaactcaaagcttgctgatggtgcctcagagagcctccatgttgaggactacaagtactgatcaatctaagtgcgggtaggaatcggtattttatgggtacaaccgaattttcttgttaatgagtattgtgcttcgactcttcccagaataataatcgtttggaatttncctttggnttccc

SEQ ID NO: 1918 - DNA, 260 bp, Glycine max
  unsure (1)..(260): unsure at all n locations
ctctaacctacctctttttcttctctctcaacnacttcancttcttcctcctgcgatcatgtctcacttcaagggcaagtacnatgacngagcttatcgccaatgctgcgtacattggcactcctggaaagggtattcttgctgctgatgagtcaanagggacaattggcaagcgtttggccagcatnngtgtanngaanattgaatccaacaggcgagctcttagggagctgcttttcactgctcctggtgttcttcaa

SEQ ID NO: 1919 - DNA, 221 bp, Glycine max
gatggctctcatgacattcacaagtgtgctgccgtcaccgagcgtgtccttgcagcatgctacaaggctttgaatgatcaccacgtccttcttgagggtaccctattgaagccaaacatggtcacccccggatccaattctgctaaggtttcccctcaggtggttgcggagacactgttagagcccttcagagaaccgtgcctgctgcagttcctgctatc

SEQ ID NO: 1920 - DNA, 262 bp, Glycine max
ccaactcagaggcaactctgggaacctacaagggtaactcaaagcttgctgatggtgcctcagagagcctccatgttgaggactacaagtactgatcaatctaagtgcgggtaggaatcggtattttatgggtacaaccgaattttcttgttaatgagtattgtgcttcgactcttcccagaataataatcgtttggaattttgctttttgttttcctagtgttccttcatatcaattttagtaattcggtgtattggtcaa

SEQ ID NO: 1921 - DNA, 145 bp, Glycine max
cgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggca

SEQ ID NO: 1922 - DNA, 239 bp, Glycine max
gctcaggaagcccttttggtaagagccaaggccaactcagaggcaactctgggaagctacaagggtaactcaaagcttgctgatggtgcctcagagagctccatgttgaggactacaagtactgatcaatctaagtgcgggtaggaatcggtattttatgggtacaaccgaattttcttgttaatgagtattgtgcttcgactcttcccagaataataatcgtttggaattttgctttt

SEQ ID NO: 1923 - DNA, 238 bp, Glycine max
tccaacctctcaagtccaacctacccctttttctgctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttaggga

SEQ ID NO: 1924 - DNA, 210 bp, Glycine max
  unsure (1)..(210): unsure at all n locations
ctttcttccaacctctcaagtccaacctaccccttnttcttctcccaccaacttcaccgtnnttcttcctcgatcatgtctcacttcaagggcaagtaccatgatgagcttattgccaatgctgcttacattggcactcctggaaagggattcttgctgctgatgagtcaacngggacatttggnagcgtttgccaagcnganatntaac

SEQ ID NO: 1925 - DNA, 263 bp, Glycine max
aacctctcaagtccaacctacccctttttcttctcccaccaacttcaccgtcttcttcctcgatcatgtctcacttcaagggcaagtaccatgatgagcttattgccaatgctgcttacattggcactcctggaaaggggtatcttgctgctgatgagtcaaccaggaccattggcaagcgttttgccaacatccgtgtagaagatgttgaattccacaaggcggctcctaaggaactggttttcaacggttcccgtgctcct

SEQ ID NO: 1926 - DNA, 271 bp, Glycine max
gagaatgtgaagaaggctcaggaagcccttttggtaagagccaaggctaactcagaggcaactctgggaacctacaagggtaactcacagcttgctgatggtgcctcagagagcctccatgtttcgaactacagctactgatcaatcgaagttggtgttgtttgaagagactagtgcgagtaggaatcggtattatgggtacaacaaccgaatttcttgttgataagtattattgtggtttgactcttcccagaataatcgtttggaattt

SEQ ID NO: 1927 - DNA, 241 bp, Glycine max
acctacctctttttcttctctctcaacgacttcttcttcttcctcctctatcatgtcttacttcaagggcaagtaccatgatgagcttattgccaatgctgcgtacattggcagtcctggaaagggtattcttgctgctgatgagtcagcagggacagttggcaatcgtttggccacaatcagtgtagacgacattgtatccaacaggcgagctcttatggagctgcttttcactgctcct

SEQ ID NO: 1928 - DNA, 274 bp, Glycine max
  unsure (1)..(274): unsure at all n locations
ancnacctntntttcttctctctcaacaacttcanccggnttcctcntcnatcangtctcacntnaaggggcaagtacnatgntgagcttatcgccaatgctgcgtacattggcactcctggaaagggtattcttgctgctgatgngtcaacagggacaattggcaagcgtttggccagncatcagtgtagagaacattgaatccaacaggngnnctcttagggagcnggctttnactgctcctggnnatctcantnnnnnnntngtgtcgtcc

SEQ ID NO: 1929 - DNA, 228 bp, Glycine max
ctcaagtccagcctacccctttttcttctcccaccaacttcaccgtcttcttcctcgatcatgtctcacttcaagggcaagtaccatgatgagcttattgtcaatgctgcttacattggcactcctggaaagggtattcatgctgctgatgagtcaacagggacaattggcaagcgtttgtccagcatcagtgtaggcgatgttgaatccaacaggcgtgctcttagg

SEQ ID NO: 1930 - DNA, 112 bp, Glycine max
gtcccaacgagccatctgagctggctatccatgagaatgcctatggcttggccagatacgctgtcatatgccaggagaatggcctggttcccattgttgagcctgagatcct

SEQ ID NO: 1931 - DNA, 190 bp, Glycine max
gcccttttggtaagagccaaggctaactcagaggcaactctgggaacctacaagggtaactcacagcttgctgatggtgcctcagagagcctccatgtttcgaactacagctactgatcaatcgaagttggtgttgtttgaagagactagtgcgagtaggaatcggtattatgggtacaacaaccgaatt

SEQ ID NO: 1932 - DNA, 92 bp, Glycine max
ggccaactcagaggcaactctggggaacctacaagggtaactcaaagcttgctgatggtgcctcagagagcctccatgttgaggactacaag

SEQ ID NO: 1933 - DNA, 232 bp, Glycine max
ggctaactcagaggcaactctgggaacctacaagggtaactcacagcttgctgatggtgcctcagagagcctccatgtttcgaactacagctactgatcaatcgaagttggtgttgtttgaagagactagtgcgagtaggaatcggtattatgggtacaacaaccgaatttcttgttgataagtattattgtggtttgactcttcccagaataatcgtttggaattttgctt

SEQ ID NO: 1934 - DNA, 148 bp, Glycine max
ctctaacctacctctttttcttctctctcaacaacttcaccttcttcctcctcgatcatgtctcacttcaagggcaagtaccatgatgagcttatcgccaatgctgcgtacattggcactcctggaaaggctgtctggccacagactt

SEQ ID NO: 1935 - DNA, 92 bp, Glycine max
cggctcgagagaatgttgaatccatcaggcggcgtcttagggagatgcttttaaccgctaccggtgatcttaaatatctcagtggtgtcatc

SEQ ID NO: 1936 - DNA, 144 bp, Glycine max
ctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagt

SEQ ID NO: 1937 - DNA, 152 bp, Glycine max
  unsure (1)..(152): unsure at all n locations
accacgtccttcttgagggtaccctattgaagccaaacatggtcacccccggatccaattctgctaagggttcccctcaggtggttgcggagacactgntagagccttcagagaaccgtgctgctgcagttctgtatcgtttcttgtctggt

SEQ ID NO: 1938 - DNA, 284 bp, Glycine max
gcgaactgttcccgctgctgttccggccattgtcttcttgtctggtgggcagagcgaggaggaggcaaccctcaacctcaacgccatgaacaagtcccagggaaagaagccgtggtccctttctttctcttttggaagggcacttcagcaaagcactctcaaggcatggggtgggaaagatgaaaacattaagaaggctcaggatgctttatttgccaggtgcaatgcaaactcacatgcaactttgggaacttacaaaggtgatgctacccttgctgagggtg

SEQ ID NO: 1939 - DNA, 283 bp, Glycine max
  unsure (1)..(283): unsure at all n locations
anagattcaacaatgggcctctggcttctgctactcttctncaagtcatctcctgttcttgacaagtgcgagtgggtctcaggccagacccttcgccaacctctcgtgagatgtaacccttcctcagcatcagctctcaccatcaaagctgcttcctatgctgacgagctcgtcaaaaccgccaaaacagtggctcaccggggcgtggtattttggcgatggatgagtcaaatgcaactgcgggaagcgtttggcatctattgggttagagaacacagaagta

SEQ ID NO: 1940 - DNA, 257 bp, Glycine max
ggttgcttggcggggataagattaaagattcaacaatggcctctgcttctgctactcttctcaagtcatctcctgttcttgacaagtgcgagtgggtcaaaggccagacccttcgccaacctctcgtgagtgtaacccttcctcagcatcagctctcaccatcaaagctgcttcctatgctgacgagctcgtcaaaaccgccaaaacagtggcctcaccggggcgtggtattttggcgatggatgagtcaaatgcaa

SEQ ID NO: 1941 - DNA, 240 bp, Glycine max
  unsure (1)..(240): unsure at all n locations
gcggggataagattagagattcactgtatngnctctgcttctgctactcgtctcaagtcatctcctgttcttgacaagtgcgggtgggtcagaggccagacccttcgccaacctctcgtgagatgtaacccttcctcagcatcagctctcaccatcaaagctgcttcctatgctgacgacgtcgtcaaaaccgccaaaacagtggcctcaccggggcgtggtattttggcgatggatgag

SEQ ID NO: 1942 - DNA, 280 bp, Glycine max
  unsure (1)..(280): unsure at all n locations
ggggataagattaaagattcaacaatggcctctgcttctgctactcttctcaagtcatctcctgttcttgacaagtgcgagtnggtcaaaggccagacccttcgccaacctctcgtgagatgtaacccttcctcagcatcagctctcaccatcaaagctgcttcctatgctgacgagctcgtcaaaaccggccaaaacagtgggcttcaccgggggncgtgggaatttgggngatggatgnngtcaanggcaaccttgggggaaggnntttggcntnnnt

SEQ ID NO: 1943 - DNA, 240 bp, Glycine max
cggggataagattaaagattcaacaatggcctctgcttctgctactcttctcaagtcatctcctgttcttgacaagtgcgagtgggtcaaaggccagacccttcgccaacctctcgtgagatgtaaccctccctcagcatcagctctcaccatcaaagctgcttcctatgctgacgagctcgtcaaaaccgccaaaacagtggcctcaccggggcgtggtattttggcgatggatgagtc

SEQ ID NO: 1944 - DNA, 174 bp, Glycine max
ataagattaaagattcaacaatggcctctgcttctgctactcttctcaagtcatctcctgttcttgacaagtgcgagtgggtcaaaggccagacccttcgccaacctctcgtgagatgtaacccttcctcagcatcagctctcaccatcaaagctgcttcctatgctgacgagc

SEQ ID NO: 1945 - DNA, 234 bp, Glycine max
aagattaaagattcaacaatggcctctgcttctgctactcttctcaagtcatctcctgttgttgacaagtgcgagtgggtcaaaggccagacccttcgccaacctctcgtgagatgtaacccttcctcagcatcagctctcaccatcaaagctgcttcctatgctgacgagctcgtcaaaaccgccaaaacagtggcctcaccggggcgtggtattttggcgatggatgagtca

SEQ ID NO: 1946 - DNA, 186 bp, Glycine max
  unsure (1)..(186): unsure at all n locations
cggggataagattaaagattcaacaatggcctctgcttctgctactcttctcaagtcatctcctgttcttgacaagtgcgagtgggtcaaaggccagacccttcgccaacctctcgtgagatgtaacccttcctcagcatcagctctcaccatcanagctgcttcctatgctgacgagancgnnaa

SEQ ID NO: 1947 - DNA, 175 bp, Glycine max
cggggataagattaaagattcaacaatggcctctgcttctgctactcttctcaagtcatctcctgttcttgacaagtgcgagtgggtcaaaggccagacccttcgccaacctctcgtgagatgtaacccttcctcagcatcagctctcaccatcaaagctgcttcctatgctgac

SEQ ID NO: 1948 - DNA, 168 bp, Glycine max
cggggataagattaaagattcaacaatggcctctgcttctgctactcttctcaagtcatctcctgttcttgacaagtgcgagtgggtcaaaggccagacccttcgccaacctctcgtgagatgtaacccttcctcagcatcagctctcaccatcaaagctgcttccta

SEQ ID NO: 1949 - DNA, 120 bp, Glycine max
atcggtttcccgccatatatccaataagctttaaccatgtctgcctttgttggaaagtacgcagatgagcttatcaagaatgccaagtacatagccacacctgggaagggcatcttggca

SEQ ID NO: 1950 - DNA, 256 bp, Glycine max
caaagctcaacaccttgtcttcccagtggctcgcccacaattccttctctcctcgccgtggatcctcttctcgccgagtctctcttccgatccgcgcttcttcttaccaacacgaactcttccaaaccgccaaatctattgcatctcccggtcgtggaattcttgcaattgatgaatcaaatgccacatgtgggaagcgtttagcatccattggattggacaatactgaggtgaatcgccaggcctataggcaact

SEQ ID NO: 1951 - DNA, 280 bp, Glycine max
  unsure (1)..(280): unsure at all n locations
accactttctgtttctcttcactctaatggccatggcagcgtctncaaagctcaacaccttgtcttcttcccagtggatcgcccacaattccttctctcctcgccgtggatcctcttctcgccgagtctctcttccgatccgcgcttcttcttaccaacacgaactcgtccaaaccgccaaatccattgcatcacccggccgtggaattcttgcaattgatgaatcaaatgccacatgtgggaaacgattagcatccattggattggacaataccgaggt

SEQ ID NO: 1952 - DNA, 268 bp, Glycine max
ctttctctttctcttcactctaaagtctaagcatccatggccatggcgtctgcaaagctcaacaccttgtcttcccagtggatcgcccacaattccttctctcctcgccgtggatcctcttctcgccgagtctctcttccgatccgcgcttcttcttaccaacacgaactcgtccaaaccgccaaatctattgcatctcccggtcgtggaattcttgcaattgatgaatcaaatgccacatgtgggaagcgtttagcatccattggat

SEQ ID NO: 1953 - DNA, 262 bp, Glycine max
actttctgtttctcttcactctaatggccatggcagcgtctgcaaagctgcacaccttgtcttcttcccagtggatcgcccacaattccttctctcctcgccgtggatcctcttctcgccgagtctctcttccgatccgcgcttcttcttaccaacacgaactcgtccaaaccgccaaatccattgcatcacccggccgtggaattcttgcaattgatgaatcaaatgccacatgtgggaaacgattagcatccattggatt

SEQ ID NO: 1954 - DNA, 262 bp, Glycine max
ctctaagcatccatggccatggcgtctgcaaagctcaacaccttgtcttcccagtggatcgcccacaattccttctctcctcgccgtggatcttcttctcgctgagttctgtcttccgatccgcgcttcttcttaccaacacgaactcgtccaaaccgccagatctattgcatctcccggtcgtggaattcttgcaattgatgaatcaaatgccacatgtgggaagcgtttagcatccattggattggacaatactgaggtg

SEQ ID NO: 1955 - DNA, 187 bp, Glycine max
gcaaagctcaacaccttgtcttcttcccagtggatcgcccacaattccttctctcctcgccgtcgatcctcttctcgccgagtctctcttccgatccgcgcttcttcttaccaacacgaactcttccaaaccgccaaatccattgcatcacccggccgtggaattcttgcaattgatgaatccaaat

SEQ ID NO: 1956 - DNA, 246 bp, Glycine max
tacagccccactttctctttctctttctcttcactctaaagtctaagcatccatggccatggcgtctgcaaagctcaacaccttgtcttcccagtggatcgcccacaattccttctctcctcgccgtggatcctcttctcgccgagtctctcttccgatccgcgcttcttcttaccaacacgaactcgtccaaaccgccaaatctattgcatctcccggtcgtggaattcttgcaatggatgaatc

SEQ ID NO: 1957 - DNA, 289 bp, Glycine max
ctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctcagtggtgtgatcttgtttgaggaaaccctataccaaaagacagcttcaggaaaacccttc

SEQ ID NO: 1958 - DNA, 284 bp, Glycine max
cctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcggaatgttgaagcaaataggcgtgctcttcgtgaactcctattcaccacacctggtgcttttgagtgcctcagtggtgtgatcttgtttgaggaaaccctataccaaaagacagcttcaggaaaacccttcgtaga

SEQ ID NO: 1959 - DNA, 290 bp, Glycine max
cttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctcagtggtgtgatcttgtttgaggaaaccctataccaaaa

SEQ ID NO: 1960 - DNA, 264 bp, Glycine max
  unsure (1)..(264): unsure at all n locations
cctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctnttcaccacacctggtgcttttgagtgcctcagtggtgtgatcttgtttgaggaaaccctatacc

SEQ ID NO: 1961 - DNA, 264 bp, Glycine max
caattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctcagtggtgtgatcttgtttgaggaaaccctataccaaaaga

SEQ ID NO: 1962 - DNA, 274 bp, Glycine max
gtcttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgctttagagtgcctcagtggtgtgatct

SEQ ID NO: 1963 - DNA, 240 bp, Glycine max
cctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctcagtggtgtga

SEQ ID NO: 1964 - DNA, 280 bp, Glycine max
ccgttgtcttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctcagtggtgtgatctt

SEQ ID NO: 1965 - DNA, 277 bp, Glycine max
cgatgtcttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctcagtggtgtgatc

SEQ ID NO: 1966 - DNA, 266 bp, Glycine max
ccgttgtcttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctc

SEQ ID NO: 1967 - DNA, 260 bp, Glycine max
cttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctca

SEQ ID NO: 1968 - DNA, 247 bp, Glycine max
cgttgtcttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacct

SEQ ID NO: 1969 - DNA, 272 bp, Glycine max
cctcgagcgaatcggctcgagcgttgtcttctcacttcgtcaacgaccaaccaaacccctccccaattctcaagccaaccatgtcgtccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggt

SEQ ID NO: 1970 - DNA, 263 bp, Glycine max
cgttgtcttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcc

SEQ ID NO: 1971 - DNA, 299 bp, Glycine max
  unsure (1)..(299): unsure at all n locations
gtcttcnnanttcgtcaaaaccaaccaaacccctccccaattctcaagccaaccatgtntcnccttcaagagcaagtacnaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctcatggtgtgatcttgtttgaggaaaccctataccaaaa

SEQ ID NO: 1972 - DNA, 235 bp, Glycine max
ttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctatccacca

SEQ ID NO: 1973 - DNA, 261 bp, Glycine max
cgttgtcttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtg

SEQ ID NO: 1974 - DNA, 256 bp, Glycine max
ctcgagccgcgttgtcttctcacttcgtcaaaaccaaccaaagcactccccaattctcaagccaaccatgtcgtccttcaagagcaagtaccaagatgaactcattgccaatgctgcttacattggcaccccagggaagggtatccttgctgctgatgagtcagctggtacaattggcaagcgaggggccagcattaatgtcgagaatgttgaagcagataggcgtgctctgcgtgaactcctattcaccacacct

SEQ ID NO: 1975 - DNA, 216 bp, Glycine max
agaaccgttgtcttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggaaagcgattggccagcattaatgtcgagaatgttgaaccaata

SEQ ID NO: 1976 - DNA, 212 bp, Glycine max
  unsure (1)..(212): unsure at all n locations
ccgttgtnttctcacttcgtcanaaccaaccaaacccctccccaattctcaagccaaccatgtcttccttcaagagcangtaccaagntgaactcattgccaatgctgctnacattggcaccccagggaagggtatccttgctgctgatgngtcaactggtacaattggcaagcgattggccagcattantgtcgagnntgttgaagcaaat

SEQ ID NO: 1977 - DNA, 147 bp, Glycine max
ccaattctcaagccaaccatgtcttccttcaagagcaagtaccaagatgaactcattgccaatgctgcttacattggcaccccagggaagggtatccttgctgctgatgagtcaactggtacaattggcaagcgattggccagcatt

SEQ ID NO: 1978 - DNA, 276 bp, Glycine max
caaggttgaacatcatcacattcgtacaacaaccaaccaaacccctccacaattctcagccaaccatgtcttccttcacaagcaagtaccaagatgaactcattgccaatgctgcttacattggcaccccagggaagggtctccttgctgctgatgaatcactggtacaattggcaagcgcttggccagcattaatgtcgagaatgttgaagcacataggcgtgctcttcgtgaactcctattcaccacacctggtgcttttgagtgcctcagtgg

SEQ ID NO: 1979 - DNA, 272 bp, Glycine max
  unsure (1)..(272): unsure at all n locations
gcctctgcatcagcatctctgctcaagtcttcacttgttcttgacaagtctgantgggtgaagggacaaanccttcgccaaccttctgcatcagttgtnagatgcaaccccaccaccccatcaggcctcaccatcagagctggttcctatgctgatgagctcgttaagaccgcgaaaacagtggcttcaccagggaggggtattttggccatggatgantccaatgctacctgtgggaagcgtttggcttcaattgggctagagaacactga

SEQ ID NO: 1980 - DNA, 295 bp, Glycine max
tgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttggccatggatgagtccaatgctacctgtgggaagcgtttggcttcaattg

SEQ ID NO: 1981 - DNA, 286 bp, Glycine max
gcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttggccatggatgagtccaatgctacctgtgggaagcgtttggcttcattgggctagagacatgaagct

SEQ ID NO: 1982 - DNA, 229 bp, Glycine max
catctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttggccatggatgagtccaatgctacctgtgggaagcg

SEQ ID NO: 1983 - DNA, 263 bp, Glycine max
gacaagtctgagtgggtgaagggacaaacacttcgccaaccttctgctgcatcagttgtgagatgcaaccccaccaccccatcaggcctcaccatcagagctggttcctatgctgatgagctcgttaagaccgcgaaaccagtggcttcaccagggaggggtattatggccatggatgagtccaatgctacctgtgggaagcgtttggcttcaattgggctagagaacactgaagctaaccgccagcataccgtaccctcctt

SEQ ID NO: 1984 - DNA, 274 bp, Glycine max
gcagtagtgctaagtgctaacacctgcagtgaacaatggcctctgcatcagcatctctgctcaagtcttcacttgttcttgccaagtctgagtgggtgaagggacaaacccttcgccaaccttctgcatcagttgtcagatgcaaccccaccaccccatcaggcctcaccatcagagctggttcctatgctgatgagctcgttaagaccgcgaaaacagtggcttcaccagggaggggtattttggccatggatgagtccactgctacctgtgg

SEQ ID NO: 1985 - DNA, 293 bp, Glycine max
  unsure (1)..(293): unsure at all n locations
tacaaaggntgctgtaggagataagattncagtagtgctaagtgctaacacctgcagtgaacantggcctctgcatcagcatctctgctcaagtcttcacttgttcttgacaagtctgagtgggtgaagggncaaacccttcgccaaccttctgcatcagttgtgagntgcaaccccaccaccccatcaggcctcaccatcagagctggttcctatgctgatgagctcgttaagaccgcgaaaacagtggcttcaccaaggaggggtattttggccatggntgagtccaatgc

SEQ ID NO: 1986 - DNA, 265 bp, Glycine max
gattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttggccatggatgagtcca

SEQ ID NO: 1987 - DNA, 282 bp, Glycine max
aaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttggccatggatgag

SEQ ID NO: 1988 - DNA, 251 bp, Glycine max
tagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttggacatggatg

SEQ ID NO: 1989 - DNA, 273 bp, Glycine max
cggctcgagggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttggccatgg

SEQ ID NO: 1990 - DNA, 286 bp, Glycine max
cagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggcggggtattcctcccatggatgagctcaatgctccctgtgggaagcg

SEQ ID NO: 1991 - DNA, 272 bp, Glycine max
caaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttgg

SEQ ID NO: 1992 - DNA, 280 bp, Glycine max
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttggccatgg

SEQ ID NO: 1993 - DNA, 284 bp, Glycine max
aaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggttcaccagggaggggtattttggccatggatgagtcca

SEQ ID NO: 1994 - DNA, 274 bp, Glycine max
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttgg

SEQ ID NO: 1995 - DNA, 252 bp, Glycine max
aggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggt

SEQ ID NO: 1996 - DNA, 269 bp, Glycine max
caaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattt

SEQ ID NO: 1997 - DNA, 256 bp, Glycine max
ctcgagccgataagattgcagtagtgctaagtgctaacacctgcagtgaacaatggcctctgcatcagcatctctgctcaagtcttcacttgttcttgacaagtctgagtgggtgaagggacaaacccttcgcaaccttctgcatcagttgtgagatgcaaccccaccaccccatcaggcctcaccatcagagctggttcctatgctgatgagctcgttaagaccgcgaaaacagtggcttcaccagggaggggta

SEQ ID NO: 1998 - DNA, 273 bp, Glycine max
ggctcatacaaaggttgctgaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggta

SEQ ID NO: 1999 - DNA, 262 bp, Glycine max
caaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggagg

SEQ ID NO: 2000 - DNA, 262 bp, Glycine max
acaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggag

SEQ ID NO: 2001 - DNA, 268 bp, Glycine max
catacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggagggg

SEQ ID NO: 2002 - DNA, 267 bp, Glycine max
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccacgccatcaggcctcaccatcagagctggttcctatgctgatgagctcgttaagaccgcgaaaacagtggcttcaccagggaggggt

SEQ ID NO: 2003 - DNA, 248 bp, Glycine max
gattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttatcaccgcgaaaacagtggcttcaccagggaggggtatttt

SEQ ID NO: 2004 - DNA, 258 bp, Glycine max
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcacca

SEQ ID NO: 2005 - DNA, 249 bp, Glycine max
aggttgctgtaggagataagattgcagtagtgctaagtgctaatgcctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttc

SEQ ID NO: 2006 - DNA, 258 bp, Glycine max; identical to SEQ ID NO: 2004

SEQ ID NO: 2007 - DNA, 257 bp, Glycine max
caaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccag

SEQ ID NO: 2008 - DNA, 256 bp, Glycine max
tacaaatgttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcac

SEQ ID NO: 2009 - DNA, 253 bp, Glycine max
ggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccag

SEQ ID NO: 2010 - DNA, 273 bp, Glycine max
tacaaaggttgctgtaggagataagattgcagtagtgctaagtgctaacacctgcagtgtacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagatggcgaaaacagtggcttcaccagggaggggtattttg

SEQ ID NO: 2011 - DNA, 265 bp, Glycine max
aaaggttgctgtaggagataagattgcagtagtgctaagtgctaacacctgcagtgaacaatggcctctgcatcagcatctctgctcaagtcttcacttgttcttgacaagtctgattgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggta

SEQ ID NO: 2012 - DNA, 265 bp, Glycine max
  unsure (1)..(265): unsure at all n locations
ctaaggtttnctgtaggagataagattgcagtagagctaagtgctaacacctgcagtgaacaatggcctctgcatcagcatctctgctcaagtcttcacttgttcttgacaagtctgagtgggtgaagggacaaacccttcgccaaccttctgcatcagttgngagatgcaaccccaccaccccatcaggcctcaccatcagagctggttcctatgctgatgagctcgttaagaccgcgaaaacagtggcttcaccagggagggg

SEQ ID NO: 2013 - DNA, 257 bp, Glycine max
acaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcacca

SEQ ID NO: 2014 - DNA, 265 bp, Glycine max
caaaggttgctgtaggagataagattgcagtagtgctaagtgctaacacctgcagtgaacaatggcctctgcatcagcatctctgctcaagtcttcagttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccatggaggggt

SEQ ID NO: 2015 - DNA, 255 bp, Glycine max
atacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttc

SEQ ID NO: 2016 - DNA, 264 bp, Glycine max
  unsure (1)..(264): unsure at all n locations
caaaggttgctgtaggagataagattgcagtagtgctaagtgctaacacctgcagtgaacaatggccttctgcatcagcatctctgctcaagtcttcacttgttcttgacaagtctgagtgggtgaagggacaaacccttcgccaaccttctgcatcagttgtgagatgcaaccccaccaccccatcaggcctcnncatcagagctggttcctatgctgatgagctcgttaagaccgcgaaaacagtggcttcaccanggaggg

SEQ ID NO: 2017 - DNA, 250 bp, Glycine max
caaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggct

SEQ ID NO: 2018 - DNA, 250 bp, Glycine max; identical to SEQ ID NO: 2017

SEQ ID NO: 2019 - DNA, 246 bp, Glycine max
caaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagt

SEQ ID NO: 2020 - DNA, 252 bp, Glycine max
acaaaggttgctgtaggagataagattgcagtagtgctaagtgctaacacctgcagtgaacaatggcctctgcatcagcatctctgctcaagtcttcacttgttcttgacaagtctgagtgggtgaggggacaaacccttcgccaaccttctgcatcagttgtgagatgcaaccccaccaccccatcaggcctcaccatcagagctggttcctatgctgatgagctcgttaagaccgcgaaaacagtggctt

SEQ ID NO: 2021 - DNA, 248 bp, Glycine max
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagt

SEQ ID NO: 2022 - DNA, 260 bp, Glycine max
caaaggttgctgtaggagataagattgcagtagtgcaaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccaggga

SEQ ID NO: 2023 - DNA, 254 bp, Glycine max
caaaggttgctgtaggagataagattgcagtagtgctaagtgctaacacctgcagtgaacaatggcctctgcatcagcatctctgctcaagtcttcacttgttcttgacaagtctgagtgggtgaagggaaaacccttcgccaaccttctgcatcagttgtgagatgcaaccccaccaccccatcaggcctcaccatcagagctggttcctatgctgatgagctcgttaagaccgcgaaaacagtggcttcacc

SEQ ID NO: 2024 - DNA, 258 bp, Glycine max
acgttgctgtaggagataagattgcagtagtgctaagtgctaacacctgcagtgaacaatggcctctgcatcagcatctctgctcaagtcttcacttgttcttgacaagtctgagtgggtgacgggacaaacccttcgccaaccttctgcatcagttgtgagatgcaaccgcaccaccccatcaggcctcaccatcagagctggttcctatgctgatgatctcgttaggaccgcgacaacagtggcttcaccagggag

SEQ ID NO: 2025 - DNA, 267 bp, Glycine max
  unsure (1)..(267): unsure at all n locations
gcagtagcgctangtgctaacacctgcagtgaacaatggcctctgcatcagcatctctggtncaagtcttcacttgttcttgacaagtctgngtgggtgaagggacaaacctttcgccaaccttctgcatcagttgtgagatgcaaccccaccaccccatcaggcctcaccatcagagntggttcctatgctgatgagctcgttaagaccgcgaaaacagtggcttcaccncggaggggtattttggcctggntgagtccaatgcnc

SEQ ID NO: 2026 - DNA, 270 bp, Glycine max
  unsure (1)..(270): unsure at all n locations
acaaaggnngctgtaggagataagattgcagtagtgctangtgctaacacctgcagtgaacaatggcctctgcatcagcatctgctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccanggaggggtatt

SEQ ID NO: 2027 - DNA, 273 bp, Glycine max
acgcgttcggctcgagattgcagtagtgctaagtgctaacacctgcagtgtacaatggcctctgcatcagcatctctgctcaagtcttcacttgttcttgacaagtctgagtgtgtgaagggacaaacccttcgccaaccttctgcatcagttgtgagatgcaaccccaccaccccatcaggcctcaccatcagagctggttcctatgctgatgagctcgttaagaccgcgaaaacagtggcttcacctcggaggggtattttggccatggat

SEQ ID NO: 2028 - DNA, 255 bp, Glycine max
acaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacgtggcttcacc

SEQ ID NO: 2029 - DNA, 265 bp, Glycine max
  unsure (1)..(265): unsure at all n locations
cggctcgagcaaaggttgctgtaggagataagattgcagttcatgctaagtgctaacacctgcagtgaacaatggcctctgcatcagaatctctgnctcagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcacc

SEQ ID NO: 2030 - DNA, 241 bp, Glycine max
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcga

SEQ ID NO: 2031 - DNA, 266 bp, Glycine max
caaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccctacaaccccatcaggcctcaccatcagagctggttcctatgctgatgagctcgttaagaccgcgaaaacagtggcttcaccagggaggggtt

SEQ ID NO: 2032 - DNA, 277 bp, Glycine max
taagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagtgcaaccccaccaccccatcaggcctcaccatcagagctggttctatgctgatgagctcgttaagaccgcgaaaacagtggttcaccagggaggggtattttggccatggatgagtccatgctacctgtgg

SEQ ID NO: 2033 - DNA, 261 bp, Glycine max
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgagagctcgttaagaccgcgaaaacagtggcttcaccaggga

SEQ ID NO: 2034 - DNA, 237 bp, Glycine max
acaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccg

SEQ ID NO: 2035 - DNA, 258 bp, Glycine max
gttgctgtaggagataagattgcagtagtgctaagtgctaacacctgcagtgaacaatggcctctgcatcagcatctctgctcaagtcttcacttgtacttgacaagtctgagtgggtgaagggacaaacccttcgccaaccttctgcatcagttgtgagatgcaaccccaccattacatcaggcacaccatcagagctggttcctatgctgatgagctcgttaagaccgcgttaacagtagcttcaccatggagggg

SEQ ID NO: 2036 - DNA, 277 bp, Glycine max
acaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcacaatcagagctggttcctatgctgatgagctcgttaagaccgcgaaaacagtggcttcaccagggagggg

SEQ ID NO: 2037 - DNA, 258 bp, Glycine max
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctggcatcagttgtgagatgcaaccccaccaccccatcaggcctcaccatcagagctggttcctatgctgatgagctcgttaagaccgcgaaaacagtggcttcacc

SEQ ID NO: 2038 - DNA, 234 bp, Glycine max
acaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaaga

SEQ ID NO: 2039 - DNA, 247 bp, Glycine max
tacaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcacaatcagagctggttcctatgctgatgagctcgttaaga

SEQ ID NO: 2040 - DNA, 260 bp, Glycine max
caactacaaaggttgctgtaggagataagatattgaagtagtgctaagtgcctaacacctgcagtgaacaatggcctctgcatcagcatcttttctcaagtcttcatatgttcttgacaagtctgagtgggtgaagggacaaacacttcgccaaccttctgctgcatcagttgtgagatgcaaccccaccaccccatcaggcctcaccatcagagctggttcctatgctgatgagctcgttaagaccgcgaaaacagtgg

SEQ ID NO: 2041 - DNA, 259 bp, Glycine max
ctcatacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttca

SEQ ID NO: 2042 - DNA, 278 bp, Glycine max
  unsure (1)..(278): unsure at all n locations
caactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcacaatcagagctggttccctatgctgatgagctcgttaagaccgcgaaaacagtggcttnaccagggaggggt

SEQ ID NO: 2043 - DNA, 238 bp, Glycine max
ggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcaccatcagagctggttcctatgctgatgagctcgttaagaccg

SEQ ID NO: 2044 - DNA, 260 bp, Glycine max
  unsure (1)..(260): unsure at all n locations
ctacaaaggttgctgtaggagataagattgcagtagtgctaagtgctaacacctgcagtgancaatggcctctgcatcagcatctctgctcaagtcttcacttgtncttgacaagtctgagtgggtgaagggacaaacccttcgccaaccttctgcntcagtngtgagatgcaaccccaccaccccatcaggcctcaccatcaganctggttcctatgctgatgagtcgttaagaccgcgaaaacagtggttcnccaggg

SEQ ID NO: 2045 - DNA, 223 bp, Glycine max
aaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagc

SEQ ID NO: 2046 - DNA, 243 bp, Glycine max
aactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcaccatcagagctggttcctatgctgatgagctcgttaag

SEQ ID NO: 2047 - DNA, 245 bp, Glycine max
caactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcacaatcagagctggttcctatgctgatgagctcgttaaga

SEQ ID NO: 2048 - DNA, 273 bp, Glycine max
gcaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcacaatcagagctggttcctatggctgatgagctcgttaagaccgcgaaaacagtggcttcaccaggg

SEQ ID NO: 2049 - DNA, 245 bp, Glycine max
tacaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcacaatcagagctggttcctatgctgatgagctcgttaa

SEQ ID NO: 2050 - DNA, 263 bp, Glycine max
  unsure (1)..(263): unsure at all n locations
tacaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcacaatcagagctgnttcctatgctgatncagctcgttaagaccgcgaaaacagtgg

SEQ ID NO: 2051 - DNA, 245 bp, Glycine max
gcatacaactacaaaggttgctgtaggagataagatattgaagtagtgctaagtgcctaacacctgcactgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcaccatcagagctggttcctatgctgatgagctcgt

SEQ ID NO: 2052 - DNA, 220 bp, Glycine max
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctg

SEQ ID NO: 2053 - DNA, 221 bp, Glycine max
cggctcgaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgct

SEQ ID NO: 2054 - DNA, 256 bp, Glycine max
caactacaaaggttgctgtaggagataagatattgaagtagtgctaagtgcctaacacctgcagtgaacaatggcctctgcatcagcatctcttctcaagtcttcacttgttcttgacaagtctagtgggtgaagggacaaacacttcgccaaccttctgctgcatcagttgtgagatgcaaccccaccaccccatcaggcctcaccatcagagctggttcctatgctgatgagctcgttaagaccgcgaaaacag

SEQ ID NO: 2055 - DNA, 288 bp, Glycine max
  unsure (1)..(288): unsure at all n locations
tacaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaancttctgctgcatcagttgtgagatgcaaccccaccaccccatcagggccttcaccatcagagctggttccctatgctgatgagcnncgttaagaccgcgaaaacagtggcttcaccagggaggggtatttc

SEQ ID NO: 2056 - DNA, 236 bp, Glycine max
tacaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcaccatcagagctggttcctatgctgatga

SEQ ID NO: 2057 - DNA, 240 bp, Glycine max
caactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacattcacttcgccaaccttctgctgcatcagttgtgagatgcaaccccaccaccccatcaggcctcacaatcagagctggttcctatgctgatgagctcgt

SEQ ID NO: 2058 - DNA, 254 bp, Glycine max
  unsure (1)..(254): unsure at all n locations
acaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgncgcatcagttgtgagatgcaancccaacaacccattcaggcctcaaaatcngagntggntcctatgcngatgagntcggcaagaccgcgaa

SEQ ID NO: 2059 - DNA, 260 bp, Glycine max
acaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcaccatcagagctggttcctatgctgatgagctcgttaagaccgcgaaaacagtg

SEQ ID NO: 2060 - DNA, 224 bp, Glycine max
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcttcaccatcagagctggttgctatgctgatga

SEQ ID NO: 2061 - DNA, 239 bp, Glycine max
tacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcaccatcagagctggttcctatgctgatgagctcgttaa

SEQ ID NO: 2062 - DNA, 220 bp, Glycine max
caaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgat

SEQ ID NO: 2063 - DNA, 227 bp, Glycine max
atacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggtccctatgctgatgagc

SEQ ID NO: 2064 - DNA, 252 bp, Glycine max
caactacaaaggttgctgtaggagataagatattgaagtagtgctaagtgcctaacacctgcagtgcacaatggcctctgcatcagcatctcttctcaagtcttcacttgttcttgacaagtctgagtgggtaagggacaaacacttcgccaaccttctgctgcatcagttgtgagatgcaaccccaccaccccatcaggcctcaccatcagagctggttcctatgctgatgagctcgtagaccgcgaaaac

SEQ ID NO: 2065 - DNA, 265 bp, Glycine max
  unsure (1)..(265): unsure at all n locations
caaaggttgctgtaggagataagattgcagtagtgcncagtgctaacacctgcagtgaacaatggcctctgcatcagcatctctgctcaagtcttcacttgttcttgacaagtctgagtgggtgaagggacaaacccttcgccaaccttctgcatcagttgtgagatgcaacccccaccaccccatcagggcctcaccatcngagctggttctatgctgatgagcncgttaaagaccgcggaaacnntgggtttcacnagggggg

SEQ ID NO: 2066 - DNA, 194 bp, Glycine max
caaaggttgctgtaggagataagaatgcagtagtgctaagtcctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctca

SEQ ID NO: 2067 - DNA, 191 bp, Glycine max
ctcatacaaaggttgctgtaggagataagattgcagtagtgctaagtgctaacaggtgcagtgaacaatggcctctgcatcagcatctctgctcaagtcttcacttgttcttgacaagtctgagtgggtgaagggacaaacccttcgccaaccttctgcatcagttgtgagatgcaaccccaccaccccat

SEQ ID NO: 2068 - DNA, 189 bp, Glycine max
catacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccat

SEQ ID NO: 2069 - DNA, 236 bp, Glycine max
ctacaaaggttgctgtaggagataagatattgaagtagtgctaagtgcctaacacctgcagtgaacaatggcctctgcatcagcatctcttctcaagtcttcacttgttcttgacaagtctgagtgggtgagggacaaacacttcgccaaccttctgctgcatcagttgtgagatgcaaccccaccaccccatcaggcctcacaatcagagctggttcctatgctgatgagctcgt

SEQ ID NO: 2070 - DNA, 244 bp, Glycine max
caactacaaaggttgctgtaggagataagatattgaagtagtgctaagtgcctaacacctgcagtgaacaatggcctctgcatcagcatctcttctcaagtcttcacttgttcttgacaagtctgagtgggtgaagggcaaacacttcgccaaccttctgctgcatcagttgtgagatgcaaccccaccaccccatcaggcctcaccatcagagctggttcctatgctgatgagctcgttaaga

SEQ ID NO: 2071 - DNA, 130 bp, Glycine max
gtgctaagtgctaacacctgcagtgaacaatggcctctgcatcagcatctctgctcaagtcttcacttgttcttgacaagtctgagtgggtgaagggacaaacccttcgccaaccttctgcatcagttgt

SEQ ID NO: 2072 - DNA, 260 bp, Glycine max
tacaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcaccatcagagctggttcctatgctgatgagctcgttaagaccgcgaaaacagt

SEQ ID NO: 2073 - DNA, 269 bp, Glycine max
tcggattctgctcgaggtgaacaatggcctctgcatcagcatctcttctcaagtcttcacttgttcttgactagtttgagtgcgtgaagggacaaacacttcgccaaccttctgctgcatcagttgtgagatgcaaccccaccactccttcaggcctcaccatcagagctgtttcctatgctgatgagctctttaagaccgcgaaaacagtggcttcacctcggaggggtattttggccatgtctgagtccactgctccctgttcgaag

SEQ ID NO: 2074 - DNA, 197 bp, Glycine max
aaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcct

SEQ ID NO: 2075 - DNA, 165 bp, Glycine max
caaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgag

SEQ ID NO: 2076 - DNA, 192 bp, Glycine max
ctacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccacccc

SEQ ID NO: 2077 - DNA, 189 bp, Glycine max
  unsure (1)..(189): unsure at all n locations
caactacaaaggttgctgtaggaganaagatattgaagtagtgctaagtgcctaacacctgcagtgaacaatngcctctgcatcagcatctcttctcaagtcttcacttgttcttgacaagtctgagtgggtgaagggacaaacacttcgccaaccttctgctgcatcagttgtgagangcaaccccac

SEQ ID NO: 2078 - DNA, 197 bp, Glycine max
ggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcac

SEQ ID NO: 2079 - DNA, 199 bp, Glycine max
caactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatca

SEQ ID NO: 2080 - DNA, 170 bp, Glycine max
  unsure (1)..(170): unsure at all n locations
caactacaaaggttgctgtaggagataagatattgaagtantgctaagtgcctaacacctgcagtgaacaatggcctctgcatcagcatctcttctcaagtcttcacttgttcttgacaagtctgagtgggtgaagggacaaacacttcgccaaccttctgctgcatcag

SEQ ID NO: 2081 - DNA, 273 bp, Glycine max
  unsure (1)..(273): unsure at all n locations
caactacaaaggttgctgtaggagataagatattgaagtagtgctaagtgcctaacacctgcagtgaacaatggcctctgcatcagcatctcttctcaagtcttcacttgttcttgacaagtctgagtgggtgaagggaaaacacttcgccaaccttctgctgcatcagttgtgagatgcaaccccaccaccccatcaggcctcacaatcagagctgcctcctatgcngatgagctcgttaagaccgcgaaaacagtggcttcaccagggagg

SEQ ID NO: 2082 - DNA, 272 bp, Glycine max
  unsure (1)..(272): unsure at all n locations
tacaactacaaaggttgctgtaggagataagatattgaagtagtgctaagtgnctaacacctgcagtgaacaatggcctctgcatcagcatctcttctcaagtcttcacttgttcttgacaagtctgagtgggtgaaggacaaacacttcgccaaccttctgctgcatcagttgtgagatgcaaccccaccaccccatcaggcctcaccatcagagctggttcctatgctgatgagctcgttaagaccgcgaaaacagtggcttcaccaggg

SEQ ID NO: 2083 - DNA, 268 bp, Glycine max
caactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcagcatcagagctggttcctatgctgatgagctcgttaagaccgcgaaaacagtggcttcacca

SEQ ID NO: 2084 - DNA, 153 bp, Glycine max
acaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctg

SEQ ID NO: 2085 - DNA, 222 bp, Glycine max
ctcgagccgaatcggctcgagcgggctcgagcaacgtacaaaggttacgctttaggagataagatattgtagtagtgctaagtgcctagcacttgcagtgaacaatggcctctgcatcagcatctcttctcaagtcttcacttgttcttgacaagtctgagtgggtgaagggacaaacacttcgccaaccttctgctgcatcagttgtgagatgcaacccca

SEQ ID NO: 2086 - DNA, 188 bp, Glycine max
atacaactacaaaggttgctgtaggagataagatattgaagtagtactaagtgcctaacacctgcagtgaacaatggcctctgcatcagcatctcttctcaagtcttcacttgttcttgacaagtctgagtgggtgaagggacaaacacttctccaaccttctgctgcatcagttgtgagatgcaacc

SEQ ID NO: 2087 - DNA, 227 bp, Glycine max
ctcgagccgcaaaggttgctgtaggagataagattgcagtagtgctaagtgctaacacctgcagtgaacaatggcctccggctcagcatctctgctcaagtcttcacttgttcttgacaagtctgagtgggtgaagggacaaacccttcgccaaccttctgcatcagctgtgagatgcaaccccaccaccccatcaggcgtcaccatcagagctggttcctatgctg

SEQ ID NO: 2088 - DNA, 106 bp, Glycine max
tgaacaagttggaggtgttgaagccatggactctctcattctcattcgggcgagcactgcaacaaagcacactcaagacatggggtggaaagaaggagaatgtcgc

SEQ ID NO: 2089 - DNA, 278 bp, Glycine max
  unsure (1)..(278): unsure at all n locations
gacgacgcgtcaatatggcatggccagatacgctgtcatatgccagaaaaagggctgggtccattgttgagcctgagatccntgttgatggatctcatgacattcacaagtgtgctgccgtcaccgaacgtgtccctgcagcatgctacaaagctttgaatgatcaccacgtccttcttgaggggtacctattgaagccaaacatggtcacccccgggatcaaatctgctaagggttcccctcaggttggtgcggancacaacggttaaagcccttca

SEQ ID NO: 2090 - DNA, 338 bp, Glycine max
agtacggctgcgagaagacgacagaagggggttcactttcttccaacctctaacctacctctttttcttctctctcaacaacttcaacttcttcctcctcgattaagttccaatttaaaggcaaattacaagattaacctaaccgcaaaaccgccttcaattggaatccctgaaaagggtattcttcctgccgataattcaacagggacaattggcaaccttttggccagcatcattgtaaaaacaattgaatccaacaggcaagctcttagggagctgcttttcattgctcctgatgttcttcaatatctcattggtgtcatcctctttaaggaaac

SEQ ID NO: 2091 - DNA, 369 bp, Glycine max
gatgagcttattgcgaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggaggctggtgtgcttcctggcatcaaggttgacaagggcacagttgagcttgctggcactaatggagaaaccaccactcagggtctagatggccttggtcagcgttgcgccaag

SEQ ID NO: 2092 - DNA, 432 bp, Glycine max
agacggctgcgagaagacgacagaagggggttcactttcttccaacctctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaacgaagctggtgtgcttcctggcatcaaggttgacaagggcacagtcga

SEQ ID NO: 2093 - DNA, 379 bp, Glycine max
ctacctctttctcttctatctcaacaactacaccttcttgctactggatcatgtctcgagttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaaagaagctggtgtgcttcctggcatcaagggtgacaagggcacagtcg

SEQ ID NO: 2094 - DNA, 411 bp, Glycine max
acctacctctttttcttctctctcaacaacttcaccttggtcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaagaaaccctctaccagagcacagctgcaggcaagccctttgtgaatgtcttgaaagaagctggtgtgcttcctggcatcaaggttgacaagggcacagtcgagcttgctggaactaatggagaaaccaccac

SEQ ID NO: 2095 - DNA, 446 bp, Glycine max
aaaaaccctacttggctcttttcttcacttgttcactttcttccaacctctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaagccaactcttaaggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaact

SEQ ID NO: 2096 - DNA, 418 bp, Glycine max
ctctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgggaatgtcttgaaggaaacctgtgtgctttcttgcattaaaggttgacaagggcacagtcgagcttgctggaactaatggagaaaccaccact

SEQ ID NO: 2097 - DNA, 417 bp, Glycine max
agcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaacagagcacccttaaggcatggggcggaaaagaagagaatgtgaagaaggctcaggaagcccttttggtaagagccaaggctaactcagaggcaactctgggaacctacaagggtaactcacagcttgctgatggtgcctcagagagcctccatgtttcgaactacagctactgatcaatcgaagttggtgttgtttgaagagactagtgcgagtaggaaatcgtattatgggtacaacaaccgaatt

SEQ ID NO: 2098 - DNA, 404 bp, Glycine max
acggctgcgagaagacgacagaagggggttcactttcttccaacctctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggc

SEQ ID NO: 2099 - DNA, 356 bp, Glycine max
ctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatc

SEQ ID NO: 2100 - DNA, 369 bp, Glycine max
ctcgagccgaatcggctcgagaacctacctgtttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttaaggagctgcttttcactgctcctggtgttcttcaatatctcagtggtgtcatcctctttgaggaaaccctctaccagagcacagctgcaggcaagccctttgtgaatgtcttgaaggaagctggtgtgc

SEQ ID NO: 2101 - DNA, 390 bp, Glycine max
acggctgcgagaagacgacagaaggggacttgttcactttcttccaacctctcaagtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttga

SEQ ID NO: 2102 - DNA, 427 bp, Glycine max
  unsure (1)..(427): unsure at all n locations
cacgcgtccagctattcctccctcctcacaaacttcactttcttcttcttcattaatgtctcacttcaagggcaagtaccatgatgagcttatcgcaaatgctgcgtacattggcactcctggaaagggtattcttgctgctgatgagtcaacagggacaattggcaagcgtttggccagcatcagtgtanagaacattgaatccaacatgcgagctcttagggagctgcttttcactgctcctggtgttcttcaatatctcagtggtgtcatcctctttgaggaaaccctctaccagagcacagctgcatgcaagccctttgtgaatgtcttgaangaagctggtgtgcttcctggcatcaatgttgacaagggcacagtcgagcttgctggaactaatggagaaaacaccactcatggtctagat

SEQ ID NO: 2103 - DNA, 392 bp, Glycine max
caacctctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaaggaaaccccttggtgaaggtcttgaaggaagctggtgtgcttcctgccatcaaggttgacaagggcacagtcgag

SEQ ID NO: 2104 - DNA, 370 bp, Glycine max
cccacgcgtgcgcccacgcgtacgcctacctatttttcttctctctcaacagcttcaggttcttcctcctcgatcatgtctcacttcaagggcaagtaccatgatgagcttatcgccaatgctgcgtacattggcactcctggaaagggtattctcgctgctgatgagtcaacagggacaattggcaagcgtttggccagcatcagtgtacagaacattgaatccaacaggcgagctcttagggagctgcttttcactgctcctggtgttcttgaatatctcagtggtgtcatcctgtttgaggaaaccctttaccagagcacagctgcaggcaagccctttgtgaatgtcttgaaagaagctggtgtgc

SEQ ID NO: 2105 - DNA, 405 bp, Glycine max
ctcaagtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccaaagcacagctgcaggcaaccccttgtggaagtcttgaaggaggctggtgtgcttcctggcatccaagttgacaagggcacagtttgagcttgctggcactaat

SEQ ID NO: 2106 - DNA, 276 bp, Glycine max
ctcaagtccaacctacccctttttcttctcccacgcaacttgaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttatggagctgcttttcaccgctcccggtgctcttaaatatctcagtggtgt

SEQ ID NO: 2107 - DNA, 401 bp, Glycine max
  unsure (1)..(401): unsure at all n locations
aagtgtgtctgagcctgacgtcgtagctattgcatcactctataagagctatgacgcacgctgacctaagcccgggattcgggttcgggatgggccccaacgagccttctgagctgtctatccatgagaacgcctatggcttggctagatacgctgtcatatgccatgagaatggcctggttcccattgttgagcctgagatccttgttgatggacctcatgacattcacaagtgtgccgncgtcaccgagcgtgtccttgcagcatgctacaaggctttgaatgatcaccatgtccttcttgagggtaccctattgaagccaaacatggtcacccctggatcccaatctgctaaggttttccctcatgtggttgccgagcacactgtcagagcccttcag

SEQ ID NO: 2108 - DNA, 309 bp, Glycine max
gacccacgcgtccgcgcactcgtccgtacggctgcgagaagacgacagaagggtacggctgcgagaagaggacagaatggtacggctgcgagaagacgacagaaggatacggctgcgagaagacgacagaagggtacggctgcgagaagacgacagaaggggaccgagcgcgttcttgcagcatgctacaaggctctaaatgatcaccatgttctgcttgagggcactctgttgaagcccaacatggtcacccctggttcaaagtctaagaaggtcaccccagatgtgattgctcaatacactgttaca

SEQ ID NO: 2109 - DNA, 215 bp, Glycine max
catggcgcggaaaagaagagattgtgaagaaggctcaggaagcccttttggtaagagccaaggctaactcagaggcaactctgggaacctacaagggtaactcacagcttgctgatggtgcctcagagagcctccatgtttcgaactacagctactgatcaatcgaagttggtgttgtttgaagagactagtgcgagtaggaatcggtattatgg

SEQ ID NO: 2110 - DNA, 428 bp, Glycine max
aaccgttgtcttctcacttcgtcaaaaccaaccaaacccctccccaattctcaagccaaccagggtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctcagtggtgtgatcttgtttgaagaaaccctataccaaaagacagcttcaggaaaacccttcgtagagttgatgaaggaaagaggagttctccctggtatcaaggttgacaagggcacagtagagcttgcaggaactaatggggagactactacttaaagg

SEQ ID NO: 2111 - DNA, 373 bp, Glycine max
tacggctgcgagaagacgacagaaggggacactccctttttaaaaccgttgtcttctcacttcgtcaaaaccaacgaggggcgtccccaagtctcaagccaaccatgtcttccttcaagagcaagtaccaggatgaactcattgccaatgctgcttacattggcaccccagggaagggtatccttgcggctgatgagtcaactggtacaagtcgcaagcgattggccagcattaatgtcgagaatgttgaagcaactaggcgtgctcttcgtgaactcggattcagcacacctggtgcttttgagtgcctcagtggtgtgatcttgtctgacgaaaccctatgccaggagacagcttcaggaaaacccttcgt

SEQ ID NO: 2112 - DNA, 370 bp, Glycine max
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccagcccatcaggcctcaccatcagagctggttcctatgctgatgagctcgttaagaccgcgaaaacagtggcttcaccagggaggggtattttggccatggatgagtccaatgctacctgtgggaagcgtttggcttcaattgggctagagaacactgaagctaaacgccaggcataccgttacctcctcg

SEQ ID NO: 2113 - DNA, 418 bp, Glycine max
agataagattgcagtactgctaagtgctaacacctgcaatgaacaatggcctctgcatcagcatctctgctcaagtcgtcacttgttcttgacaagtctgagtgggtgaagggacaaacccttcgccaaccttctgcatcagttgtgagatgcaaccccaccaccccatcaggcctcagcatcagagctggttcctatgctgatgagctcgttaagaccgcgaaaacagtggcttcaccagggaggggtattttggccatggatgactccaatgctacctgtgggaagcgtttggcttcaattgggctatagaacactgaagctaaccgccatgcatagcgtaccctcctcgtgacagttccaggccttggtcagtacatctctggtgccattctctttgaggaaacactctaacaat

SEQ ID NO: 2114 - DNA, 267 bp, Glycine max
ctcgagccactcgagccgctaaaaactgggatgaccctactaccaagtatgtggagaaatgcaagtataccaagagatggttcatcaccaaagtccctaagatatattggaagcatggtagctgatgttcaccgcacattgctttatggaggtatttttctgtatccggctgataaaaagagtccaaatggaaaacttcgtgtactctatgaagtcttcccaatgtcattcttgatggaacaagcaggaggacaggctttcactggc

SEQ ID NO: 2115 - DNA, 271 bp, Glycine max
agaagagaagtggatatgagcttcaaacactcactaactggatgctgaagcaggagcaagctggggtgattgatgcagaactcactattgtgctgtctagcatttccatggcgtgcaatcagattgcttctttggtgcaaagagccaacatttccaacctcactggggttcaaggagctgtcaatgttcagggggaagaccagaaaaagcttgatgttgtttcaaatgaggtcttctcatactgcttgaggtcaagtgggaggacagggat

SEQ ID NO: 2116 - DNA, 261 bp, Glycine max
gaaatgccaaaaactgggatcgtcctactgctacttacgttgaaaaatgcaagtttcctgaagatggttcatcaccaaagtctctaagatatattcggaagtatgggtagctgatgttcatcgtacgttgctttatggaggcatctttttgtaccctgttgacaaaaaaagtccaaatggaaaacttcgtgtcctgtatgaagtcttcccaatgtcattcttgatggaacaggcaggaggacagtctttcacgggcaagga

SEQ ID NO: 2117 - DNA, 257 bp, Glycine max
atcaagtggcaggagaaggcatgtggggggttctggagttaggtgcatggctgtgggggaagcagcaaccactgggacaaagaagagaagtggatatgagcttcaaacactcactagctggttgctgaagcaggagcaagctggggtgattgatgcagaactcactattgtgctgtctagcatttccatggcatgcaaacagattgcttctttggtgcaaagagctaacatttccaacctcactggggttcaaggtg

SEQ ID NO: 2118 - DNA, 271 bp, Glycine max
  unsure (1)..(271): unsure at all n locations
gaagtataactgcttactttccctcaaaatgatactttaatctaagtattttatctaaataaattctatagccctgaccggcacatcaaccaaagtctctaagatatattggaagcatggtagctgatgttcatcgtacgttgctttatggaggcatctttttgtaccctgctgacaaaaaaagtccaaatggaaaacttcgtgtcctgtannnagtcttcccaatgtcattcttgatggaacaggcaggaggacagtctttcacgggcaa

SEQ ID NO: 2119 - DNA, 291 bp, Glycine max
  unsure (1)..(291): unsure at all n locations
gagcaggcaaaatttatgctttcaatgaagggacttatccagttgtgggatgacaagcttaagaaatatattgatgatctcaaggncccangtcctagcggnaagccttattctgcaaggtacattggtagcttggtaggagacttccacaggnccactgctatatggtgncattnatgggtaccccanggnccaagccaaagtaacnatgggcaattcaagctncantaggangggccnccatnancttccntattngccccggctgggggaaaaggtcccntgcccccc

SEQ ID NO: 2120 - DNA, 258 bp, Glycine max
  unsure (1)..(258): unsure at all n locations
gtgaacgtgtgccaacccggaagcaaccttcttgcagctggttactgcatgtattctagctccaataatctttgttctcacccttgggaatggagtgtttgtgtttacattggacccgatgtatggcgaattcgttttgactcaggaaaacctncaaatacctagagcaggcaaaatttatnctttcaatgaagggaatnatcattgtggganccncacntaaggaaantntntggacaancnangncccncgcnccc

SEQ ID NO: 2121 - DNA, 157 bp, Glycine max
atggtagctgatgttcatcgtacgttgctttatggaggcatctttttgtaccctgctgacaaaaaaagtccaaatggaaaacttcgtgtcctgtatgaagtcttcccaatgtcattcttgatggaacaggcaggaggacagtctttcacgggcaagg

SEQ ID NO: 2122 - DNA, 262 bp, Glycine max
tcacagtgccgatgctcaacgcacggacttgatgaccatcacccgcttcgtgctgaaccaacaatccaaccaccctgagtctcgtggcgatttctcaatcttgctcagtcacattgttctcggttgcaagttcctctgctctgctgttaacaaggcgggtcttgctaagcttattggacttgcaggagagacaaatgttcagggcgaagagcaaaagaaactggatgtcctttccaatgatgtctttatcaaggctttggtc

SEQ ID NO: 2123 - DNA, 241 bp, Glycine max
ggatcacagtgccgatgctcaacgcacggacttgatgaccatcacccgcttcgtgctgaaccaacaatccaaccaccctgagtctcgtggcgatttctcaatcttgctcagtcacattgttctcggttgcaagttcctctgctctgctgttaacaaggcgggtcttgctaagcttattggacttgcaggagagacaaatgttcaggggaagagcaaaagaaactggatgtcctttccaatg

SEQ ID NO: 2124 - DNA, 261 bp, Glycine max
  unsure (1)..(261): unsure at all n locations
acatacacccacatatttcatatgggtacttgttaatttgggtgtggattgttggtttgtnacttgtnttgttccgttcaggtgattgtntgattgagccttgaagaaatggaccacagcgctgatgcacatcgcacggacttgatgaccataacgcggttcgtgctgaacgagcaatccaagcaccccgagtcacgcggcgatttcaccatcttgctcagtcacattgttctcggttgcaagttcgnttgttccgctgtc

SEQ ID NO: 2125 - DNA, 258 bp, Glycine max
  unsure (1)..(258): unsure at all n locations
ttattatactttcttcttcttctttattattgttgattaatataacatacacccacatatttcatatgggtacttgttaatttnggtgtggattgttagtttgttacttgtttgttccgttcaggtgattgtttgattgagccttgaagaaatggaccacagcgctgatgcacatcgcacggacttgatgaccataacgcggttcgtgctgaacgagcaatccaagcaccccgagtcacgcggcgatttcaccatctt

SEQ ID NO: 2126 - DNA, 257 bp, Glycine max
tccaacctcactggggttcaaggagctgtcaatgttcagggggaagaccagaaaaagcttgatgttgtttcaaatgaggttttctcaaactgcttgaggtcaagtgggaggacagggataatagcatcagaggaggaagatgtgccagtggcagtagaagagagttattctggaaactacattgtggtgtttgacccacttgatgggtcatccaatattgatgctgcagtgtcaactgggtccatttttgggatata

SEQ ID NO: 2127 - DNA, 253 bp, Glycine max
tcagggggaagaccagaaaaagcttgatgttgtttcaaatgaggttttctcaaactgcttgaggtcaagtgggaggacagggataatagcatcagaggaggaagatgtgccagtggcagtagaagagagttattctggaaactacattgtggtgtttgacccacttgatgggtcatccaatattgatgctgcagtgtcaactgggtccatttttgggatatacagccccaatgatgagtgtctgctgacattg

SEQ ID NO: 2128 - DNA, 228 bp, Glycine max
tatcagaaaaagcttgatgttgtttcaaatgaggttttctcaaactgcttgaggtcaagtgggaggacagggataatagcatcagaggaggaagatgtgccagtggcagtagaagagagttattctggaaactacattgtggtgtttgacccacttgatgggtcatcccatattgatgctgcaatgtcaatggggtccatttttgggatatacagccccatgatgagt

SEQ ID NO: 2129 - DNA, 284 bp, Glycine max
atcaacaaaccaaaaaggtaaactttttgcaacaaccatggttgcaatggcagcagcaacagcatccacccagttgattttctcaaagccttgttccccttcacgtctatgccccttccaactatgtgtctttgacactaaacaagtgctatcaagtggcaggagaaggcatgtggggggttctggagttaggtgcatggctgtgggggaagcagcaaccactgggacaaagaagagaagtggatatgagcttcaaacactcactagctggttgctgaagcagg

SEQ ID NO: 2130 - DNA, 276 bp, Glycine max
caaaaaggtaaactttttgcaacaaccatggttgcaatggcagcagcaacagcatccacccagttgattttctcaaagccttgttccccttcacgtctatgccccttccaaccatgtgtctttgacactaaacaagtgctatcaagtggcaggagaaggcatgtggggggttctggagttaggtgcatggctgtgggggaagcagcaaccactgggacaaagaagagaagtggatatgagcttcaaacactcactagctggttgctgaagcaggag

SEQ ID NO: 2131 - DNA, 283 bp, Glycine max
caaaaaggtaaactttttgcaacaaccatggttgcaatggcagcagcaacagcatccacccagttgattttctcaaagccttgttccccttcacgtctatgccccttccaactatgtgtctttgacactaaacaagtgctatcaagtggaggagaaggcatgtggggggttctggagttaggtgcatggctgtgggggaagcagcaaccactgggacaaagaagagaagtggatatgagcttcaaacactcactagctggttgctgaagcaggagcagctggg

SEQ ID NO: 2132 - DNA, 289 bp, Glycine max
aatcaacaaaccaaaaaggtaaactttttgcaacaaccatggttgcaatggcagcagcaacagcatccacccagttgattttctcaaagccttgttccccttcacgtctatgccccttccaactatgtgtctttgcacactaaacaagtgctatcaagtggcaggagaaggcatgtggggggttctggagttaggtgcatggctgtgggggaagcagcaaccactgggacaaagaagagaagtggatatgagcttcaaacactcactagctggttgctgaagcaggagc

SEQ ID NO: 2133 - DNA, 274 bp, Glycine max
  unsure (1)..(274): unsure at all n locations
actttttgcaacaaccatggttgcaatgggcagcagcaacagcatccacccagttgattttctcaaagccttgttcccccttcacgtctatgccccttccaactatgtgtctttnacactaaacaagtgctatcaagtggcaggagaaggcatgtggggggttctggagttaggtgcatggctgtgggggaagcagcaaccatgggacaaagaagagaagtggatatgagcttcaaacactcactagctggttgctgaagcaggagcaagctgg

SEQ ID NO: 2134 - DNA, 252 bp, Glycine max
aaaaggtaaactttttgcaacaaccatggttgcaatggcagcagcaacagcatccacccagttgattttctcaaagccttgttccccttcacgtctatgccccttcgaactatgtgtctttgacactaaacaagtgctatcaagtggcaggagaaggcatgtggggggttctggagttaggtgcatggctgtgggggaagcagcaaccactgggacaaagaagagaagtggatatgagcttcaaacactcac

SEQ ID NO: 2135 - DNA, 275 bp, Glycine max
  unsure (1)..(275): unsure at all n locations
ttttgcaacaaccatggttgcaatgggcagcagcaacagcatccacccagttgattttctcaaagccttgttccccttcacgtctatgccccttccaactatgtgtctttgacactaaacaagtgctatcaagtggcagganaaggcatgtggggggttctggagttaggtgcatggctgtgggggaagcagcaaccactgggacaaagaananaagtggatatgagcttcaaacactcactagtggttgctgaanaggagcaagctggggtgnt

SEQ ID NO: 2136 - DNA, 253 bp, Glycine max
caaaaaggtaaactttttgcaacaaccatggttgcaatggcagcagcaacagcatccacccagttgattttctcaaagaccttgttccccttcacgtctatgccccttccaactatgtgtctttgacactaaacaagtgctatcaagtggcaggagaaggcatgtggggggttctggagttaggtgcatggctgtgggggaagcagcaaccactgggacaaagaagagaagtggatatgagcttcaaacactc

SEQ ID NO: 2137 - DNA, 254 bp, Glycine max
aaaaggtaaactttttgcaacaaccatggttgcaatggcagcagcaacagcatccacccagttgattttctcaaagccttgttccccttcacgtctatgccccttccatctatgtgtctttgacactaaacaagtgctatcaagtggcaggagaaggcatgtggggggttctggagttaggtgcatggctgtgggggaagcagcaaccactgggacaaaaagagaagtggatatgagcttcaaacactcactag

SEQ ID NO: 2138 - DNA, 262 bp, Glycine max
ttctcaaagccttgttccccttcacgtctatgccccttccaactatgtgtctttgacactaaacaagtgctatcaagtggcaggagaaggcatgtggggggttctggagttaggtgcatggctgtgggggaagcagcaaccactgggacaaagaagagaagtggatatgaacttcaaacactcactagctggttgctagaacaggagcaagctggggtgattgatgcagaactcatattgtgctgtctagcatttccatggc

SEQ ID NO: 2139 - DNA, 285 bp, Glycine max
caaaaaggtaaacttttgcaacaaccatggttgcaatggcagcagcaacagcatcctcccagttgattttctcaaagcctcgctcaccctcgcgtctctgtcccttccaactaacggtctttgacaccaaacaagtgctgtcaagttcaagtggcaggagaaggcatgtggggggttctggagttaggtgcatggcggtgggagaagctgcaaccactgagactaagaagagaagtggatatgagcttcaaacactcactaactggttgctgaagcaggagcaag

SEQ ID NO: 2140 - DNA, 251 bp, Glycine max
atggttgcaatggcagcagcaacagcatccacccagttgattttctcaaagccttgttccccttcacgtctatgccccttccaactatgtgtctttgacactaaacaagtgctatcaagtggcaggagaaggcatgtggggggttctggagttaggtgcatggctgtgggggaagcagcaaccactgggacaaagaagagaagtggatatgagcgtgatcactcactagctggttgctgaagcaggagcaa

SEQ ID NO: 2141 - DNA, 275 bp, Glycine max
caaaaaggtaaacttctgcaacaaccatggttgcaatggcagcagcaacagcatcctcccagttgattttctcaaagcctcgttcaccctcgcgtctctgccccttccacactatgtgtctttgacaccaaacaagtgctgtcaagttcaagtggcaggagaaggcatgtggggggttctggagttaggtgcatggcggtgggagaagctgcaaccactgagactaagaagagaagtggatatgagcttcaacactcactaactggttgctgaag

SEQ ID NO: 2142 - DNA, 248 bp, Glycine max
caacaaaccaaaaaggtaaactttttgcaacaaccatggttgcaatggcagcagcaacagcatccacccagttgattttctcaaagccttgttccccttcacgtctatgccccttccaactatgtgtctttgacactaaacaagtgctatcaagtggcaggagaaggcatgtggggggttctggaatagagtgcatggctgtgggggaagcagcaaccactgggacaaagaagagaagtggatatgag

SEQ ID NO: 2143 - DNA, 348 bp, Glycine max
  unsure (1)..(348): unsure at all n locations
aaatctttttgctcttagtgccttagtacacaatccatgtaaccaccactagtgctaaaatcatcaaccaaaaaggtaaacttctgcaacaaccatggttgcaatggcagcagcaacagcatcctcccagttgattttctcaaagcctcgttcaccctcgcgtctctgcnccttccaactatgtgtctttgacaccaaacaagtgctgtcaagttcaagtggcaggagaaggcatgtggggggttctggagttaggtgcatggcggtgggagaagctgcaaccactgagactaagaagagaagtggatatgagcttcaaacactcactaactggttctgaagcaggac

SEQ ID NO: 2144 - DNA, 283 bp, Glycine max
caaaaaggtaaacttctgcaacaaccatggttgccaatggcagcagcaacagcatcctcccagttgattttctcaaagcctcgttcaccctcgcgtctctgccccttccaactatgtgtctttgacaccaaacaagtgctgtcaagttcaagtggcaggagaaggcatgtggggggttctggagttaggtgcatggcggtgggagaagctgcaaccactgagactaagaagagaagtggatatgagcttcaaacactcactaactggttgctgaagcaggagc

SEQ ID NO: 2145 - DNA, 246 bp, Glycine max
aaacttctgcaacaaccatggttgcaatggcagcagcaacagcatcctcccagttgattttctcaaagcctcgttcaccctcgcgtctctgacccttccaactatgtgtctttgacaccaaacaagtgctgtcaagttcaagtggcaggagaaggcatgtggggggttctggagttaggtgcatggcggtgggagaagctgcaaccactgagactaagagagaagtggatatgagcttcaaacact

SEQ ID NO: 2146 - DNA, 257 bp, Glycine max
caaaaaggtaaacttctgcaacaaccatggttgcaatggcagcagcaacagcatcctcccagttgattttctcaaagcctcgttcaccctcgcgtctctgccccttccaactatgtgtctttgacaccaaacaagtgctgtcaagttcaagtggcaggagaaggcatgtggggggttctggagttaggtgcatggcggtgggagaagctgcaaccactgagactaagaagagaagtggatatgagcttcaaacactc

SEQ ID NO: 2147 - DNA, 278 bp, Glycine max
  unsure (1)..(278): unsure at all n locations
caaaaaggtaaacttctgcaacaaccatggttgcaatggcagcagcaacagcatcctcccagttgattttctcaaagcctcgttcaccctcgcgtctctgcnccttccaactatntgtctttgacaccaaacaagtgctgtcagttcaagtggcaggagaaggcctgtggggggntctggagttnggtgcatggcggtgggagaagctgcaaccatgagactangnagagaagtggatatgagcttcaaacatcataactggttgctgaagcaggagc

SEQ ID NO: 2148 - DNA, 246 bp, Glycine max
aaacttctgcaacaactatggttgcaatggcagcagcaagagcatcctcccagttgattttctcaaagcctcgttcaccctcgcgtctctgccccttccaactatgtgtctttgacaccaaacaagtgctgtcaagttcaagtggcaggagaaggcatgtggggggttctggagttaggtgcatggcggtgggagaagctgcaagcactgagactaagaagaaagtggatatgagcttcaaacact

SEQ ID NO: 2149 - DNA, 250 bp, Glycine max
aaacttctgcaacaaccatggttgcaatggcagcagcaacagcatcctcccagttgattttctcaaagcctcgttcaccctcgcgtctctgccccttccagctatgtgtctttgacaccaaacaagtgctgtcaagttcaagtggcaggagaaggcatgtggggggttctggagttaggtgcatggcggtgggagaagctgcaacacctgagactaagaagagaagtggatatgagcttcaaacactcac

SEQ ID NO: 2150 - DNA, 269 bp, Glycine max
  unsure (1)..(269): unsure at all n locations
caaaaaggtaaacttcngcaacaaccatggttnccaatggcagcagcaacagnatcctcccagtngattttctcaaagcctcgttgcancctcgcgtctctgccccttccaactatgngtctttgncaccaaacaagtgctgtcaagttcaagtggcaggagaaggcatgtggggggttctggagttaggtgcatggcggtgggagaagctgcaaccactgagactaagaagagaagtggatatgagcttcaaacactcantaactggt

SEQ ID NO: 2151 - DNA, 222 bp, Glycine max
aaaatcaacaaaccaaaaaggtaaactttttgcaacaaccatggttgcaatggcagcagcaacagcatccacccagttgattttctcaaagccttgttccccttcacgtctatgccccttccaactatgtgtctttgacactaaacaagcgctatcaagtggcaggagaaggcatgtggggggttctggagttaggtgcatggctgtgggggaagcagcaac

SEQ ID NO: 2152 - DNA, 192 bp, Glycine max
gtaaactttttgcaacaaccatggttgcaatggcagcagcaacagcatccacccagttgattttctcaaagccttgttccccttcacgtctatgccccatccaactatgtgtctttgacactaaacaagtgctatcaagtggcaggagaaggcatgtggggggttctggagttaggtgcatggctgtggggg

SEQ ID NO: 2153 - DNA, 247 bp, Glycine max
caaccaaaaaggtaaacttctgcaacaaccatggttgcaatggcagcagcaacagcatcctcccagttgattttctcaaagcctcgttcaccctcgcgtctctgccccttccaactatgtatcttgacaccaaacaagtgctgtcaagttcaagtggcaggagaaggcatgtggggggttctggagttaggtgcatggcggtgggagaagctgcaaccactgagactaagaagagaagtggatatga

SEQ ID NO: 2154 - DNA, 255 bp, Glycine max
  unsure (1)..(255): unsure at all n locations
acacaatccatgtaancaccactagcaccataccacactgccaaaatcancaaaccaaaaaggtaaactttttgcaacaaccatggttgcaatggcagcagcaacagcatccacccagttgattttctcaaagccttgttccccttcacgtctatgccccttccaactatgngnctgnactaaacaagtgntatcaagtggcaggagaaggnatgtggggggttctggagtnaggtgcatggctgtgggggaagc

SEQ ID NO: 2155 - DNA, 225 bp, Glycine max
tacggctgcgagaagacgacagaaggggaccactagtgctaaaatcatcaaccaaaaaggtaaacttctgcaacaaccatggttgcaatggcagcagcaacagcatcctcccagttgattttctcaaagcctcgttcaccctcgcgtctctggcccttccaactatgtgtctttgacaccaaacaagtgctgtcaagttcaagtggcaggagaaggcatgtgggg

SEQ ID NO: 2156 - DNA, 218 bp, Glycine max
ctttgctctcagtgccttagaacacaatccatgtaaccaccacaagcaccataccacactgccaaaatcaacaaaccaaaaaggtaaactttttgcaacaaccatggttgcaatggcagcagcaacagcatccacccagttgattttctcaaagccttgttccccttcacgtctatgccccttccaactatgtgtctttgacactaaacaagtgctat

SEQ ID NO: 2157 - DNA, 135 bp, Glycine max
caaaaaggtaaactttttgcaacaaccatggttgcaatggcagcagcaacagcatccacccagttgattttctcaaagccttgttccccttcacgtctatgccccttccaactatgtgtctttgacactaaacaa

SEQ ID NO: 2158 - DNA, 92 bp, Glycine max
gtaaacttctgcaacaaccatggttgcgatggcagcagcaacagcatcctcccagttgattttctcaaagcctcgttcaccctcgcgtctct

SEQ ID NO: 2159 - DNA, 236 bp, Glycine max
tgagccttctaagcgcggaaagtactgtgtttgctttgacccattggatggctcgtccaacattgattgtggggtttccattggcacaatttttggggtttatgcgttgaaagatgtccatgaaccaaccatagaagatgtcctgcttcctgggaagaacatggtggcagctggttactgtatgtatggaagctcttgcacgcttgtgttaagcactggagcaggtgttaatggtt

SEQ ID NO: 2160 - DNA, 280 bp, Glycine max
gcaacagccactaagatgttctttgagtcttggcacgccacgtgtcagaactgccaacagatagcaccatctctttctccttctccctaaacctcgaactcagcacccccatccactggtgattgtttgattgagccttgaagaaatggaccacagcgctgatgcacatcgcacggacttgatgaccataacgcggttcgtgctgaacgagcaatccaagcaccccgagtcacgcggcgatttcaccatcttgctcagtcacattgttctcggttgcaag

SEQ ID NO: 2161 - DNA, 363 bp, Glycine max
  unsure (1)..(363): unsure at all n locations
caaaactttcatatccccgaaattctctctttttccactgttccctaggaaatatttattctcatcttcatcctctacacaacacctaagatcggacaagagggaactcataatttataaaaagaacattgagaaagagagaagggaagaagaatggaccaccaagctgacactaacagaactgatttgatgacatcacacgctttgttctgaatgaacagtcaaagtatcccgantcacgtggcgatttcaccatccttctcagtcacatggttctgggctgnaatccgtttgttctgctgtnaanaggngggttggcgaaacccaaggattgcggaganncattttcaggggggacaaaaa

SEQ ID NO: 2162 - DNA, 393 bp, Glycine max
ccccactccatcatttattatactttcttcttcttctttattattgttgattaatataacatacacccacatatttcatatgggtacttgttaatttgggtgtggattgttggtttgttacttgttttgttccgttcaggtgattgtttgattgagccttgaagaaatggaccacagcgctgatgcacatcgcacggacttgatgaccataacgcggttcgtgctgaacgagcaatccaagcaccccgagtcacgcggcgatttcaccatcttgctcagtcacattgttctcggttgcaagttcgtttgttccgctgttaacaaaggctggccttgctaaacttattggactcgctggagaaaccaatgttcaaggtgaagaacagaataaac

SEQ ID NO: 2163 - DNA, 123 bp, Glycine max
cttcaatgttggtaagtatcgtcgccttaagcatggttctagtcagtctgctgatttctttcgagctgacaatcctgaaggtgtggaggcacgtaatgaggtagcaaagatggcatttgaaga

SEQ ID NO: 2164 - DNA, 243 bp, Glycine max
gatttctttcgagctgacaatcctgaaggtgtggaggcacgtaacgaggtagcaaagatggcatttgaagatatgatatcttggatgcaagaaggtggccaggttgggatatttgatgccacaaacagtagcaagcagcgaagaaacatgctgatgaaattggctgaaggtagatgcaagatcatttttctggaaacaatatgcaatgatgtagacataattgagaggaatattcgctttaaa

SEQ ID NO: 2165 - DNA, 260 bp, Glycine max
cttgagcattatgttgtcccaactcccgcaactgctgcaaattcagcacatgtatatgccgctaacatgacagagaatccaaggtcactaatttgtgggtctggcagcagttcatatcccatcaaggagatgcaggttattgtgcctgatccatctaagatttttcaaagttctggaatggttgaatccaagtcagttggaacattttcacctctgcaaaagcaagagagtcagaggggactttttgttgatagaggtgt

SEQ ID NO: 2166 - DNA, 390 bp, Glycine max
cccacgcgtccgtacggctgcgagaagacgacagaaggggggatgacgtatgaagaaatcaagaagaacatgccagaggagtatgaatcccgcaataaggacaaacttaggtatcgttatcctcgtggagagtcttacttagatgttattcaaaggttagaacctgtaattattgaacttgagcgacaacgagcacctgttgttgtgatatctcaccaggcagttttgagggcattatatgcttattttactgacaggcctttgaaagaaattgcagatattgagatgcccctccatacgataatagaaatacaattgggagttacaggtgtcgaagagaaaagatacaaactaatggactgaaatgaataactgaaggagagaagaaac

SEQ ID NO: 2167 - DNA, 122 bp, Glycine max
  unsure (1)..(122): unsure at all n locations
ggtgagtaaccatgatgagctaatgtccaactattttgcacagtctgatgcccttgcatatnnnaagacagcagagcagctgcnaaaggncaatgtttccccgcaccttattccacacaaga

SEQ ID NO: 2168 - DNA, 234 bp, Glycine max
tgataatcctccactcaagataacatacatggacaacacggatcctgctggaattgatcatcagattgcacaacttgggcctgagctagcttcaacacttgtgattgtgatatcaaagagtggaggtactcctgagaccagaaatggtttattggaagtgcagaaggcctttcgtgaagcaggcttggattttcctaaacagggtgttgctataacacaagaaaattctttgtt

SEQ ID NO: 2169 - DNA, 205 bp, Glycine max
ttcctatgtttgattgggcaggaggtagaacgtcagagatgtctgcagttggcctgcttccagcagcccttcagggtattgatattagagaaatgcttgccggtgcatcattgatggatgaggctaataggagtactgtgttaaggaataaccctgcagctctgctggctttatgttggtattgggctacagatggtgtaggatc

SEQ ID NO: 2170 - DNA, 223 bp, Glycine max
tgcagggcgttgctataactcaagaaaattctttgctggataacactgcaagaattgagggttggttagctagatttccaatgtttgactgggtgggaggtagaacatcagagatgtctgcagtgggcctgcttccagcagcccttcagagcattgacataagagaaatgcttgctggtgcagcattaatggatgaggcgaataggagtactgtgataaggaa

SEQ ID NO: 2171 - DNA, 218 bp, Glycine max
tgcagggcgttgctataactcaagaaaattctttgctggataagactgcaagaattgacggttggttagctagatttccaatgtttgactgggtgggaggtagaacatcagagatgtctgcagtgggcctgcttccagcagcccttcagagcattgacataagagaaatgcttgctggtgcagcattaatggatgaggcgaataggagtactgtgata

SEQ ID NO: 2172 - DNA, 273 bp, Glycine max
gtgctacgtgatagacctcctggtcatgattgggaacttgaacctggtgtcacatgcggtgactacttgtttggtatgctacagggaacaagatcagctctgtatgccaataaccgagagtccatcacagttactgtacaagaagtgacacctagaacagttggtgctcttattgcactctatgaacgagcagtaggaatttatgcctcccttgtcaacataaatgcttatcatcaaccaggtgtggaagctggtaaaaaagcagcaggtgaa

SEQ ID NO: 2173 - DNA, 257 bp, Glycine max
aacaattgagggaaggtgtacacaatttctttgtaacattcattgaggtgctacgtgatagacctcctggtcatgattgcgaacttgaacctggtgtcacatgcggtgactacttgtttggtatgctacagggaacaagatcagctctgtatgccaataaccgagagtccatcacagttactgtacaagaagtgacacctagaactgttggtgctcttattgcactctatgaacgagcagtaggaatttatgcctcc

SEQ ID NO: 2174 - DNA, 248 bp, Glycine max
tacggctgcgagaagacgacagaaggggattgggaacttgaacctggtgtcacatgtggtgactacttgtttggtatgctacagggaacaaggtcggctttgtatgccaataaccgagagtccatcacagttactgtacaagaagggacaccaagaacagttggtgctcttattgggctctatgaacgagcagtaggaatttatgcctcccttgtcaacataaatgcttatccttttcctcgtgtgga

SEQ ID NO: 2175 - DNA, 236 bp, Glycine max
atcctgcagctttgctggctttatgttggtattgggctacagatggtgtaggatcaaaagatatggttatccttccatataaggacagctttctattatttagtagatacttgcaacagttggtcatggaatctctaggcaaggagtttgacttgaatggtaatcgggttaatcaaggaattagtgtctatggaaataaaggaagcacagatcagcatgcctacattcaccaactg

SEQ ID NO: 2176 - DNA, 270 bp, Glycine max
cagcatgcctacattcagcaactgagggaaggtgtgcacaatttttttgtgacattcattgaggtgctacgcgatagaccacctggtcatgattgggagcttgaaccaggtgtcacatgtggtgactacctgtttggtatgctacagggaacaaggtcagccctgtatgccaataaccgtgaatccatcactgtcacagtgcaagaagtgacacccagatcagttggtgcccttgtagccctttatgaacgggccgttggaatatatgct

SEQ ID NO: 2177 - DNA, 259 bp, Glycine max
ggagtttgacttgaatggtaatcgggttaatcaaggaattagtgtctatggaaataaaggaagcacagatcagcatgcctacattcaacaactgagggaaggtgtgcacaatttttttgtgacattcattgaggtgctacgcgatagaccacctggtcatgattgggagcttgaaccaggtgtcacatgtggtgactacctgtttggtatgctacagggaacaaggtcagccctgtatgccaataaccgtgaatccatc

SEQ ID NO: 2178 - DNA, 227 bp, Glycine max
atagaagtactgtgttaaggaataaccctgcagctctgctggctttatgttggtattgggctacagatggtgtaggatccaaggatatggttattcttccgtacaaggacagcctgttattattcagtagatacttgcagcagctggtcatggaatctctaggcaaggagtttgacttggatggtaatcgggttaatcaaggaattagtgtctatggaaacaaagga

SEQ ID NO: 2179 - DNA, 263 bp, Glycine max
  unsure (1)..(263): unsure at all n locations
ttcagggcattgatattagagaaatgcttgcnggtgcatcattgatggatgaggctaatagaagtactgtgttaaggaataaccctgcagctntgctggcttangnaaggtattgggctacagatggtgtaggaccaagganatggttattcttccgtacaaggacagcctngtattattcagtagatacntgcagcagctggtcatggaatctctaggcaaggagtttgacttggatggtaatcgggttaatcaaggaatag

SEQ ID NO: 2180 - DNA, 263 bp, Glycine max
gcgcgatcgcgaatcccgatgagagtcgcatggtgggacactattggctgagggaccctaagcgtgcgcccaactcgttccttaaaacgcagattgagaacactctcgacgctgtttgcaagttcgctaacgacgtcgttagtggtaagattaagcctccttcgtctccggagggtcgatttactcaaatattgtctgtgggaattggaggttctgctcttggaccacagtttgttgcagaagcattggcacctgataatcct

SEQ ID NO: 2181 - DNA, 398 bp, Glycine max
  unsure (1)..(398): unsure at all n locations
gaataaatggttaaggcaaaaaggattacggtgataaggaataatcctgcacctttgctggctttatgttggtattgggctacagatggtgtaggatcaaaagatatggttatccttccatataaggacagcttgttattatttagtagatacttgcaacagttggtcatggaatctctaagcaaggagtttgacttgaatggtaatcgggttaatcaaggaattagtgtctatggaaataaaggaagcacagatcagcatgcctacattcagcaactganggaaggtgtgcacaatttttttgtgacattcattgangtgctacgcgatagaccacctggtcatgattgggagcttgaacaagtgtcacatgtggtgactacctgtttggtatgcta

SEQ ID NO: 2182 - DNA, 362 bp, Glycine max
gttggagaagggcgcgatcgcgaatcccgatgagagtcgcatggtgggacactattggctgagggaccctaagcgtgcgcccaactcgttccttaaaacgcagattgagaacactctcgacgctgtttgcaagttcgctaacgacgtcgttagtggtaagattaagcctccttcgtctccggagggtcgatttactcaaatattgtctgtgggaattggaagttctgctcttggaccacagtttgttgcagaagcattggcacctgataatcctccactcaagataagatttgtggacaacacggatcctgctggaattgatcatcagattgcacaacttgggcctgagctagcttcaacac

SEQ ID NO: 2183 - DNA, 243 bp, Glycine max
  unsure (1)..(243): unsure at all n locations
ctgagttccgccattacactgacatcaatgagcttcctccacatcggcttgctgaaatcagaagattctttgaggactacaagaagaatgagaacaaaatagttgatgttgaagactttctaccggctgaagctgccattgatgccatcaattactccatggacttgtatgctgcttacatagttgagagctaaggnactaacttctctanagacnntgtancncnntnngngngctctccaa

SEQ ID NO: 2184 - DNA, 262 bp, Glycine max
ctcctcttaatgagaggattatttcatccatgaccagaagatctgttgctgcacacccgtggcacgaccttgagatagggcctggtgctccaacgatcttcaattgtgtgattgagattgggaaagggagcaaggtgaaatatgaactggacaaaaaatcgggtcttatcaagatcgaccgtgtccattactcatcagttgtgtatcctcacaattatgggtttatcccacgtactatttgtgaggacagtgatcccctgga

SEQ ID NO: 2185 - DNA, 254 bp, Glycine max
ggagccagttcttccaggttgctttctacgggccaaagctattggactcatgcctatgattgatcagggtgagaaagatgacaagataattgctgtctgtgctgatgatcctgagtataggcattacaatgatatcaaggaccttcctcctcaccgtttagctgaaattcgtcgtttctttgaagattacaagaagaatgagaacaaggaagttgcagtgaacgactttcttcctgcttcagctgcctatgaag

SEQ ID NO: 2186 - DNA, 246 bp, Glycine max
gcattattgtctgtttgattactactctctttgcaactgatttctttgagatcaaggctgtcaaggaaattgaaccagctttgaaaaagcagcttatcatctctacagtactcatgactgttggaattgcaattattagttggattgctctgccaacatccttcacaattttcaactttggcgctcagaaggaagtaaagagctggcagctgttcctctgtgtgggtgttggtctatgggctggac

SEQ ID NO: 2187 - DNA, 259 bp, Glycine max
caacactggcggtgcttgggataatgctaagaagtacatagaggctggtgcgtctgagcatgcaaggaccctgggccagcaaggatctgaaccacataaggcagctgttattggagataccattggagaccctcttaaagatacttcaggtccttcactcaacatcctcatcaagctcatggccgttgagtcgctcgtcttcgcaccatttttcgccactcacggtggcctgcttttcaagatcttttgatttgagggt

SEQ ID NO: 2188 - DNA, 188 bp, Glycine max
gcctctgttccgccaagcgcagataagacccaccgttcaggccaccggctgagttaggtttccggcgaggatcggtgctgctctgctgtcggagcttgcgacggagatagtcgtgccagtgtgcgccgtcatcgggatcgggtcctggctggtgcagtggttcctcgtgtcgcgcgtcaagctcactc

SEQ ID NO: 2189 - DNA, 242 bp, Glycine max
ctgctggcaacactactgctgccataggcaagggatttgctattgggtctgccgctctggtgtctttggccctatttggtgcatttgtgagcagggctggaatttcaactgttgatgtcttgacacccaaggtctttattggactcatagttggtgccatgcttccttactggttttccgctatgaccatgaagagtgttggaagtgcagctttgaagatggttgaggaggttcgtaggcag

SEQ ID NO: 2190 - DNA, 313 bp, Glycine max
  unsure (1)..(313): unsure at all n locations
gctctgtgngaaggcttcagtactaagancnagncctgcacatatgatnagangcgagctatanaagccagcccntgncgacttgcnttgnttagccctgtcatctntcntggcntggtgctatnacttcngtcctatcnngnntccttaggctannaattgncagcctgtgccaatgcnaggacnaaccttagcagccaganagggagttggataggctttgnatactgcatttaggnctggtgcagtgatgggtttccnncntggnggaaatggtcttntggngnnctacattnaccatcaatctcttcag

SEQ ID NO: 2191 - DNA, 119 bp, Glycine max
  unsure (1)..(119): unsure at all n locations
cccatggcntgaccttgagatcggacctggngctccaattntcntcaattgtgtgattnaaattgggnnagggancnaggngaaatntgnactggacacaaagtcggggctnatcaang

SEQ ID NO: 2192 - DNA, 258 bp, Glycine max
agatgacaagataattgctgtctgtgctgatgatcctgagtataggcattacaatgatatcaaggagcttcctccacaccgtttagctgaaattcgtcgtttctttgaagattacaagaagaatgagaacaaggaagttgcagtgaacgactttcttcctgcctcagctgcctatgaagcgatcaagcattccatgaccttatatgcggaatacgttgtggagaacttgaggcggtagtgttgattcctgggtgcttg

SEQ ID NO: 2193 - DNA, 263 bp, Glycine max
gcgcaacccagctgttattgcagacaacgtaggagctaatgttggagatatcgctgggatgggttcagacttatttgggtcttatgcagaatcatcatgtgcagctttatttgtagcatccatatcatcgtttggaacaaatcatgatcacacagccatgtcatatcctctcatcataagctccatgggaattgtggtttgcttgattacgactctttttgcaactgatctgtttgaacttaaaaacgtgagccaaatagaac

SEQ ID NO: 2194 - DNA, 168 bp, Glycine max
cggctcgaggggagaggaagcaaggtgagatatttacttgacaaaagaactggaaatattatggttgatcgtatactacactcatcagtagtttatcctcacaactatgggaatattccacgtactatttgtgaggacagtgatcccatggatgtcttgggtattatg

SEQ ID NO: 2195 - DNA, 194 bp, Glycine max
cgcgttcactgcaatgttatatcccctactcatcagttctatgggcattattgtctgtttgattactactctttttgcaactgatttctttgcgatcaaggctgtcaaggaaattgaaccagctctaaaaaagcagcttatcatctctacagtactcatgactgttggaattgccattattagttggattgctc

SEQ ID NO: 2196 - DNA, 190 bp, Glycine max
gtgatcccctggatgtcttgattattatgcaggagccggttcttccaggttgctttcttcgggccaaagcaattggtctcatgcccatgattgatcagggggagaaagatgataaaattattgctgtctgtgctgatgatcctgagtatagacattacaatgatatcaaagagcttcctccacatcgttt

SEQ ID NO: 2197 - DNA, 265 bp, Glycine max
  unsure (1)..(265): unsure at all n locations
agtgttttgcttttgctgttgtacaagatgagtgatgagaatggcgaagaacctcgagaaaaccgtccggttccacgcttgaatgaaaggattctttcatctctgtctaggagatcagttgctgctcacccttgcatgatcttgaaattggacctggagcgcctatgattttcaattgtgttgtggagatcactaagggaagcaaggtcaaatacgaacttgacaaaaagacnggattaattaaggttgatcggattctgtactc

SEQ ID NO: 2198 - DNA, 260 bp, Glycine max
tttcaaagtatttgcttttattttttggtgaaaaagtgttttgcttttgctgttgtacaagatgagtgatgagaatggcgaagaacctcgagaaaaccgtccggttccacgcttgaatgaaaggattctttcatctctgtctaggagatcagttgctgctcacccttggcatgatcttgaaattggacctggagcgccttgattttcaattgtgttgtggagatcactaagggaagcaaggtcaaatacgaacttgacaa

SEQ ID NO: 2199 - DNA, 236 bp, Glycine max
acacgttctctgtgactgcctctgttccgccaagcgcagcattgccccaccgttcaggccaccggctgagttaggtttccggcgaggatgggtgctgctctgctgtcggagcttgcgacggagatagtcgtgccagtgtgcgccgtcatcgggatcgtgttctcgctggtgcagtggttcctcgtgtcgcgcgtcaagctcactcccgaccgcaacggaacgacgtcgtcgccgcg

SEQ ID NO: 2200 - DNA, 272 bp, Glycine max
atgaaattgaaccagctctaaaaaagcagcttatcatctctacagtactcatgactgttggaattgcaattattagttggattgctctgccaacatccttcacaattttcaactttggtgctcagaaggaagtaaagagctggcactgttcctctgtgtgggtgttggtctatgggctggacttattattgcgtttgttactgagtactatacaagcaatgcttacagtcctgtacaagatgttgctgattcctgccggactggagctgcaa

SEQ ID NO: 2201 - DNA, 251 bp, Glycine max
attgaaccagctctaaaaaagcagcttatcatctctacagtactcatgactgttggaattgcaattattagttggattgctctgccaacatccttcacaattttcaactttggtgctcagaaggaagtaaagagctggcagctgttcctctgtgtgggtgttggtctatgggctggacttattattgggtttgttactgagtactatacaagcaatgcttacagtcctgtacaagatgttgctgattcctg

SEQ ID NO: 2202 - DNA, 244 bp, Glycine max
cggaaggcttcagtactaagagccagccctgcacatatgataagagcaagctatgcaagccagcccttgcgactgcattgtttagcactgtatctttcttgcttggtgctataacttcagtcctatctggtttccttgggatgaaaattgcaacctatgccaatgcaaggacaaccttggaagccagaaagggagttggaaaggctttcattactgcatttaggtctggtgcagtgatgggttt

SEQ ID NO: 2203 - DNA, 268 bp, Glycine max
  unsure (1)..(268): unsure at all n locations
gagccagccctgcacatatgataagagcnagctatgcaagccagcccttgcgactgcattgtttagcactgtatctttcttgcttggtgctataacttcagtcctatctggtttccttgggatgaaaattgcaacctatgccaatgcaaggacaaccttggaagccagaaagggagttggaaaggcttcattactgatttaggtctggtgcagtgacgggtttccttcttgcagcaaatggtcttttggtgccctacattaccatcaa

SEQ ID NO: 2204 - DNA, 232 bp, Glycine max
  unsure (1)..(232): unsure at all n locations
tcacccctggcacgacttagagattgggccaggagctccagcagttttcaactgtgtggttgaaattggcaaaggaagtaaggttaagtatgagctggacaagacaagtggacttataaaggttgatcgtattctttactcatcagtagtctacccacacaactaacgatattnnccaanaaccatttgtgaagacagtgatcctatggacgtgctggttctaatgcaggaa

SEQ ID NO: 2205 - DNA, 266 bp, Glycine max
ctcaccttgaagattcaagtgcatggaattcgagtatacctcaccctaagctcaatgaaagaattctgtcttctctgtcacggagaactgttgctgctcacccctggcacgatttagagattgggccaggagctccagctgttttcaactgtgtggttgaaattggcaaaggcagtaaggttaagtatgagctggacaagacaagtggacttataaaggttgatcgtattctttactcatcagttgtctacccacacaactatggt

SEQ ID NO: 2206 - DNA, 290 bp, Glycine max
agtttctcttatctctaagtcaacatggctcaccatgaagattcaagtgtatggaattcgagtatacctcaccctaagctcaatgaaagaattttgtcttctctgtcacggagaactgttgctgctcacccctggcacgatttagagattgggccaggagctccagctgttttcaactgtgtggttgaaattggcaaaggcagtaaggttaagtatgagctggacaagacaagtggacttataaaggttgatcgattctgtactcatcagttgtctacccacacaactat

SEQ ID NO: 2207 - DNA, 296 bp, Glycine max
  unsure (1)..(296): unsure at all n locations
ctccgactcnttctcttaatcccnaaagtcaacatgggctcaccttggaagatncaagtggcatgggaattcgagtatacctcaccctaagctncaatgaaagaattctgtcttctctgtcacggagaactgttgctgctcacccctggcacgatttagagattggggccaggagctccagctgttttcaactgtgtggttgaaattggcaaaggcagtaaggttaagtatgagctggacaagacaagtggacttataaaggntgatcgtattctttactcatcagttgtctaccc

SEQ ID NO: 2208 - DNA, 259 bp, Glycine max
ctttctcttatctctaagtcaacatggctcaccttgaagattcaagtgcatggaattcgagtatacctcaccctaagctcaatgaaagaattctgtcttctctgtcacggagaactgttgctgctcacccctggcacgatttagagattgggccaggagctccagctgttttcaactgtgtggttgaaattggcaaaggcagtaaggttaagtatgagctggacaagacaagtggacttataaaggttgatcgtattct

SEQ ID NO: 2209 - DNA, 287 bp, Glycine max
tttcgcactttctttcagtcaccatctccgactctttctcttatctctaagtcaacatggctcaccttgaagattcaagtgcatggaattcgagtatacctcaccctaagctcaatgaaagaattctgtcttctctgtcacggagaactgttgctgctcacccctggcacgatttagagattgggccaggagctccagctgttttcaactgtgtggttgaaattggcaaaggcagtaaggttaagtatgagctggacaagacaagtggacttataaaggttgatcgt

SEQ ID NO: 2210 - DNA, 281 bp, Glycine max
ctttcactcaccagtcaccacctctgaactctctctctcatctataagtcaacatggctcatcatgaagattcaagtgcatggaattcgagtaaacctcaccctaagctcaatgaaagaattctgtcttctctgtcacggagaactgttgctgctcacccctggcacgacttagagattgggccaggagctccagcagttttcaactgtgtggttgaaattggcaaaggaagtaaggttaagtatgagctggacaagacaagtggacttataaaggttgat

SEQ ID NO: 2211 - DNA, 242 bp, Glycine max
ctctcatctataagtcaacatggctcatcatgaagattcaagtgcatggaattcgagtaaacctcaccctaagctcaatgaaagaattctgtcttctctgtcacggagaactgttgctgctcacccctggcacgacttagagattgggccaggagctccagcagttttcaactgtgtggttgaaattggcaaaggaagtaaggttaagtatgagctggacaagacaagtggacttataaagg

SEQ ID NO: 2212 - DNA, 255 bp, Glycine max
tccgactctttctcttatctctaagtcaacatggctcaccatgaagattcaagtgtatggtattcgagtatacctcaccctaagctcaatgaaagaattttgtcttctctgtcacggagaactgttgctgctcacccctggcacgatttagagattgggccaggagctccagctgttttcaactgtgtggttgaaattggcaaaggcagtaaggttaagtatgagctggacaagacaagtggacttataaaggtt

SEQ ID NO: 2213 - DNA, 246 bp, Glycine max
tctgaactctctctctcatctataagtcaacatggctcatcatgaagattcaagtgcatggaattcgagtaaacctcaccctaagctcaatgaaagaattctgtcttctctgtcacggagaactgttgctgctcacccctggcacgacttagagattgggccaggagctccagcagttttcaactgtgtggttgaaattggcaaaggaagtaaggttaagtatgagctggacaagacaagtggact

SEQ ID NO: 2214 - DNA, 246 bp, Glycine max; identical to SEQ ID NO: 2213

SEQ ID NO: 2215 - DNA, 266 bp, Glycine max
ctcaccagtcaccacctctgaactctctctctcatctataagtcaacatggctcatcatgaagattcaagtgcatggaattcgagtaaacctcaccctaagctcaatgaaagaattctgtcttctctgtcacggagaactgttgctgctcacccctggcacgacttagagattgggccaggagctccagcagttttcaactgtgtgggttgaaattggcaaaggaagtaaggttaagtatgagctggacaagacaagtggacttat

SEQ ID NO: 2216 - DNA, 248 bp, Glycine max
  unsure (1)..(248): unsure at all n locations
cagtcaccacctctgaactctctctctcatctataagtcaacatggctcatcatgaagattcaagtgcatggaattcgagtaaacctcaccctaagctcaatgaaagaattctgtcttctctgtcacggagaactgttgctgctcacccctggcacgacttagagattgggccaggagctccagcagttttcaactgtgtggttgaaattggcaaaggaagtaaggttaagtatgagnctgacaagac

SEQ ID NO: 2217 - DNA, 242 bp, Glycine max
ccagtcaccacctctgaactctctctctcatctataagtcaacatggctcatcatgaagattcaagtgcatggaattcgagtaaacctcaccctaagctcaatgaaagaattctgtcttctctgtcacggagaactgttgctgctcacccctggcacgacttagagattgggccaggagctccagcagttttcaactgtgtggttgaaattggcaaaggaagtaaggttaagtatgagctgg

SEQ ID NO: 2218 - DNA, 246 bp, Glycine max
  unsure (1)..(246): unsure at all n locations
tncgactctttctcttatctctaagtcaacatggctcaccttgaagattcaantgcatggnattcgagtatacctcaccctaagctcaatgaaagaattctgtcttctctgtcacggagaactgttgctgctcacccctggcacgatttgagattgggccaggagctccagctgttttcaactgtgtggttgaaattggcaaaggcagtaaggttangtatgagctggacagacaagnggattata

SEQ ID NO: 2219 - DNA, 249 bp, Glycine max
gtcaccacctctgaactctctctctcatctataagtcaacatggctcatcatgaagattcaagtgcatggaattcgagtaaacctcaccctaagctcaatgaaagaattctgtcttctctgtcacggagaactgttgctgctcacccctggcacgacttagagattgggccaggagctccagcagttttcaactgtgtggttgaaattggcaaaggaataacgtaagtatgagctggcagacaagtgga

SEQ ID NO: 2220 - DNA, 196 bp, Glycine max
ctgaactctctctctcatctataagtcaacatggctcatcatgaagcattcaagtgcatcgaattcgagtagacctcaccctaagctcaatgaaagaattctgtcatctctgtcacggagaactgttgctgctcacccctggcacgacttagagattgggccaggagttccagcagttttcaactgtgtggttgaa

SEQ ID NO: 2221 - DNA, 227 bp, Glycine max
ccaagacgagcttcaccttgcgccgaaggccacagatggttgaaaccgatatggatgccgaaactgttgcaaatgtggttccaccaaaggagactcctcacagtgttcccatctcttatcattcctcacactcacacccttctcttaatgagaggattatttcatccatgaccagaagatctgttgctgcacacccgtggcacgaccttgagatagggcctggtgct

SEQ ID NO: 2222 - DNA, 253 bp, Glycine max
gaacaatagtagcaagcagagccccaagacgagcttcaccttgcgccgaagggccacagatggttgaaaccgatatggatgccgaaactgttgcaaatgtggttccaccaaaggagactccaaacatgttcccatctcttatcattcctcacactcacaccctcctcttaatgagagattatttcatccatgaccagaagatctgttgctgcacacccgtggcacgaccttgagatagggcctggtgctccaa

SEQ ID NO: 2223 - DNA, 276 bp, Glycine max
gtcgaaatagggaaaggaagcaaggtgaaatatgaacttgacaaaagaactggacttattatggttgatcgtatactttactcatcagttgtttatcctcacaactatgggttcattccacgtactatttgtgacgacggtgatcccatggatgtcttggttattatgcaggagccagttcttccgggttgctttcttcgggccaaagctattggtctcatgcctatgattgatcagggtgagacagatgacaagataattgctgtctgtgctgat

SEQ ID NO: 2224 - DNA, 269 bp, Glycine max
taggacctgaagctccaaagatcttcaactgtgtggttgaaattgggaaaggaagtaaggtgaaatatgaacttcacaaaagaactggtcttattatggttgatcgtatcctttactcatcggctgtgtatcctcacaactatgggtttatcccacgtactatttgtgaggatggtgatcccatggatgtcttggttatcatgcaggagccagttcttccaggttgctttctacgggccaaagctattggactcatgcctatgattgat

SEQ ID NO: 2225 - DNA, 276 bp, Glycine max
cttaacgagaggattctttcatccatttccaggagacacgttgctgcacacccgtggcacgatcttgagataggacccgaagctccaaagatcttcaactgtgtggtcgaaatagggaaaggaagcaaggtgaaatatgaacttgacaaaagaactggacttattatggttgatcgtatactttactcatcagttgtttatcctcacaactatgggtttattccacgtactatttgtgaggacggtgatcccatggatgtcttggtattatgcagg

SEQ ID NO: 2226 - DNA, 240 bp, Glycine max
ggaaacatgttgctgctcacccgtggcatgatcttgagataggacctgaagctccaaagatcttcaactgtgtggttgaaattgggaaaggaagtaaggtgaaatatgaacttgacaaaagaactggtcttattatggttgatcgtatcctttactcatcggttgtgtatcctcacaactatgggtttatcccacgtactatttgtgaggacggtgatcccatggatgtcttggttatca

SEQ ID NO: 2227 - DNA, 239 bp, Glycine max
acttattatggttgatcgtatactttactcatcagttgtttatcctcacaactatgggtttattccacgtactatttgtgaggacggtgatcccatggatgtcttggttattatgcaggagccagtcttccgggttgctttcttcgggccaaagctattggtctcatgcctatgattgatcagggtgagaaagatgacaagataattgctgtctgtgctgatgatcctgagtataggca

SEQ ID NO: 2228 - DNA, 268 bp, Glycine max
taggacctgaagctccaaagatcttcaactgtgtggttgaaattgggaaaggaagtaaggtgaaatatgaacttgacaaaagaactggtcttattatggttgatcgtatcctttcctcatcggttgtgtatcctcacaactatgggtttatcccacgtactatttgtgaggatggtgatcccatggatgtcttggttatcatgcaggagccagttcttccaggttgctttctacgggccaaagctattggactcatgcctatgattga

SEQ ID NO: 2229 - DNA, 269 bp, Glycine max
ctgtttcttctttttctccaaccttcgtttcaccaccacacttacattactttgtcgaaatggctccaccaattgagaccccaaacaaggtttccagctatcaacagtccccaaaccctcgtcttaacgagaggattcttagatacatttccaggagacacgttgctgcacacccgtggcacgatcttgagataggacccgtagctccaaagatcttcaactgtgtggtcgaaatagggaaaggaagcaaggtgaaatatgaacttgac

SEQ ID NO: 2230 - DNA, 269 bp, Glycine max
ttctcactctagatctgtgtttctctctccaaccttcgtttcaccacacttccatcacttgtcgagtgtagaaatggctccaccaattgagaccccaaccaaggtttccagctatcagcactccccaaaccctcgtcttaacgagaggattctttcatccatttccaggaaacatgttgctgctcacccgtggcatgatcttgagataggacctgaagctccaaagatcttcaactgtgtggttgaaattgggaaaggcagtaaggtga

SEQ ID NO: 2231 - DNA, 283 bp, Glycine max
  unsure (1)..(283): unsure at all n locations
atttcatttcactcactcantcttcgtttcgtttctctttctcactctagatctgtgtttctctctaccaaccttcgtttcaccacacttccatcacttgtcgagtgtagaaatggctccaccaattgagaccccaaccaaggtttccagctatcagcactccccanaccctccgtcttaacgagaggattctttcatccatttccaggaaacatgttgctgctcacccgtggcatgatcttgagataggacctgaagctccaaagatcttcaactgtgtggt

SEQ ID NO: 2232 - DNA, 269 bp, Glycine max
attccacacacaccacaacatcacactctctagatctctgtttcttctttttctccaaccttcgtttcaccaacacacttacattactttgtcgaaatggctccaccaattgagaccccaaacaaggtttccagctatcaacagtccccaaaccctcgtcttaacgagaggattctttcatccatttccaggagacacgttgctgcacacccgtggcacgatcttgagataggacccgaagctccaaagatcttcaactgtgtggtcga

SEQ ID NO: 2233 - DNA, 444 bp, Glycine max
  unsure (1)..(444): unsure at all n locations
tacggctgcgagaagacgacagaaggggacacacgttctctgtgactgcctctgttccgccaagcgcagcattttcccaccgttcaggccaccggctgagttaggtttccggcgaggatgggtgctgctctgctgtcggagcttgcgacggagatagtcgtgccagtgtgcgccgtcatcgggatcgtgttctcgctggtgcagtggttcctcgtgtcgcgcgtcaagctcactcccgaccgcaacggaacgacgtcgtcgccgcgcaacaacaaaaacggctacggcgacttcctcattgaagaggaagaaggcatcaacgaccacagcgtcgttgtgaaatgcgctgagatacagaacgctatctccgaaggtgcaacatcctttcttttcactgaatatcaatatgtgnggattttcatggttgcttttgcaatactgatc

SEQ ID NO: 2234 - DNA, 436 bp, Glycine max
  unsure (1)..(436): unsure at all n locations
ctgcctctgttccgccaagcgcagcattttcccaccgttcaggccaccggctgagttaggtttccggcgaggatgggtgctgctctgctgtcggagcttgcgacggagatagtcgtgccagtgtgcgccgtcatcgggatcgtgttctcgctggtgcagtggttcctcgtgtcgcgcgtcaagctcactcccgaccgcaacggaacgacgtcgtcgccgcgcaacaacaaaaacggctacggcgacttcctcattgaagaagaagaaagcatcaacgaccacagcgtcgttgtgaaatgcgctgagatacagaacgctatctccgaaggtgcaacatcctttcttttcactgaatatcaatatgtggggatcttcatggttgcttttgcaatactgatcttnctttttctgtgctctgtggaaggcttcagtacta

SEQ ID NO: 2235 - DNA, 408 bp, Glycine max
acggctgcgagaagacgacagaagggggagcttccctcacacattctctgtgactgcctctgttccgccgaacccagcattttcccaccgttcgggccaccggcggagttagttttccggcaaggatgggtgctgctctgctgtctgagcttgcgacggagatagttgtgccggcctgcgccgtcatcgggatcgtgttctcgttggtgcagtggttcctcgtgtcgcgcgtcaagctcactcccgaccgaaacggaacgacgtcgtcgccgcgcaacaacaagaacggctacggcgacttcctcattgaggaggaagaaggcatcaacgaccacagcgtcgttgtgaaatgcgctgagatacagaacgctatctccgaaagtgcaacatcctttcttttcactgaat

SEQ ID NO: 2236 - DNA, 396 bp, Glycine max
gactctttctcttatctctaagtcaacatggctcaccttgaagattcaagtgcatggaattcgagtatacctcaccctaagctcaatgaaagaattctgtcttctctgtcacggagaactgttgctgctcacccctggcacgatttagagattgggccaggagctccagctgttttcaactgtgtggttgaaattggcaaaggcagtaaggttaagtatgagctggacaagacaagtggacttataaaggttgatcgtattctttactcatcagttgtctacccacacaactatggttttatcccaagaaccatttgtgaagacagtgatcctatggacgtgctggttctaatgcaggaacccgtgcttcctggttccttccctcgtgctcgtgct

SEQ ID NO: 2237 - DNA, 376 bp, Glycine max
agtaaggctgcgagaagacgacagaaggggacagaagaatagtagcaatcagagactgaagacgagcttccccttgcgccgaagggccaccgatggttgaaaccgagatggatgcagaaactgttgcaaatgtggttccaccaaaggagactccaaatagtgtttccatttctcatcattcctcacaccctccccttaatgagaggattatttcatccatgaccaggagatctgttgctgcacacccatggcatgaccttgagaataggactggtgctcaaattatcttcaattgtgtgattgaaattgggaaagggaccaaggtgaaatatgaactggacaaaaagtcggggcttatcaagatcgaccgcgtgct

SEQ ID NO: 2238 - DNA, 352 bp, Glycine max
agtacggctgcgagaagacgacagaaggggacagaacaatagtagcaagcagagccccaagatctgtgcttgaaccttcacgtgtgtttccttccttctgcagacgagcttcaccttgcgccgaagggccacagatggttgaaaccgatatggatgccgaaactgttgcaaatgtggttccaccaaaggagactccaaacagtgttcccatctcttatcattcctcacactcacaccctcctcttaatgagaggattatttcatccatgaccagaagatctgttgctgcacacccgtggcacgaccttgagataaggcctgatgctccaacgatcttcaattgtgtgattga

SEQ ID NO: 2239 - DNA, 251 bp, Glycine max
agtacggctgcgagaagacgacagaaggggcacacccgtggcacgatcttgagataagacccgaagctccaaagatcttcaactgtgtggtcgaaataaggaaaggaagcaaggtgaaatatgaacttgacaaaagaactggacttattatggttgatcgtatactttactcatcagttgtttatcctcacaactatgggtttattccacgtactatttgtgaggacggtgattccatggatgtcctgggt

SEQ ID NO: 2240 - DNA, 401 bp, Glycine max
gagactcaacaagcattccactcacacctcatcgtttctctctctagatctctgtttcttctttttctccaaccttcgtttcaccaccacacttacattactttgtcgaaatggctccaccaattgagaccccaaacaaggtttccagctatcaacagtccccaaaccctcgtcttaacgagaggattctttcatccatttccaggagacacgttgctgcacacccgtggcacgatcttgagataggacccgaagctccaaagatcttcaactgtgtggtcgaaatagggaaaggaagcaaggtgaaatatgaacttgtcaaaagaactggacttattatggttgatcgtatactttactcatcagttgtttatcctcacaactatgggtttattccacgt

SEQ ID NO: 2241 - DNA, 411 bp, Glycine max
  unsure (1)..(411): unsure at all n locations
agtacggctgcgagagacgacagaaggggagactcaacaagcattccactcacacctcatcgtttctctctctagatctctgtttcttctttttctccaaccttcgttttaccaccacacttacattactttgtcgaaatggctccaccaattgagaccccaaacaaggtttccagctatcaacagtccccaaaccctcgtcttaacgagaggattctttcatccatttccgggagacacgttgctgcacacccgtggcacgatcttgagatanngaccgaagctccaaagatcttcaactgtgtggtcganatanggaaaggaagcaaggtgaaatatgaacttgacaaaagaactggacttattatggttgatcgtatactttactcatcagttgtttatcctcacaac

SEQ ID NO: 2242 - DNA, 273 bp, Glycine max
caacaacaacaacaacgttgtagtgtgttgttttgttttttagtgcagtttatttttttggcatcaaagtggttgaatccatggattgtggttatggtattcccagggaactctcagatcttcagaagattcggtctttgtaccagccagagctccctccttgtctccagggaaccactgtgagggttgaatttggtgacgcaaccaccactgctgaccccactgatgcagtcaccgtctgcagggcttttcgtggcgcttgtggacaccttt

SEQ ID NO: 2243 - DNA, 340 bp, Glycine max
  unsure (1)..(340): unsure at all n locations
aaccatggctatgtctactattttgcttttgactttcttttctttcatttatggcagtgcagctactcatcacgtttatagaaatcttcagagtttatcttctgattcctccaaccaacctnacagaactgcttatcacttccaacctcccaagaattggataaatgatcccaatggaccatgagatatgcaggactttaccacctattctatcaatacaatcctaaaggtgcagtttggggaaatattgtgtgggcacattcagtgtcaaaggatctngtgaattggactccactagatcctgccatttttncatctcaaccgtccgatataatggctg

SEQ ID NO: 2244 - DNA, 273 bp, Glycine max
  unsure (1)..(273): unsure at all n locations
aaaatgganggtagtcattggtgctcaaaatggggatgaagggaagacaattctctaccaaagtgaggattttgttaattggagtccggaattgaaccctttttttgcaacagataacactggagtttgtgagtgtccagatttttnctcctgtgtccatcaatagcacaaatggggtggatncatctgtccaaagtncaaagtgttagaacatgtcttgaagataacnactacgtagacatcaggatatnatcttcnggtaaataggtctat

SEQ ID NO: 2245 - DNA, 276 bp, Glycine max
aacaccctcagaaccctgtcatgagtccaccaagtggagttgccgtgaataacttcagagacccttcaactgcttggcagggaaaggatggaaaatggagggtagtaattggtgctcaaaatggtgatgaagggaagacaattctctaccaaagtgaggactttgttaattggaaagtggatcctaatcccttctacgcatcagataataccggagtttgtgagtgtccagacttcttccctgttaacatcagtggcagcaaaaatggggtggata

SEQ ID NO: 2246 - DNA, 267 bp, Glycine max
gctaacatgatcaattcaagctcatttagggatcctaccactgcttggctaggcaaagatgggtactggagggtgctgattggaagcaaaatacacactaggggtatggcaattttgtacaagagcaaaaactttgttaattgggttcaagccaaacaacccctacattcagctgaaggcactggaatgtgggagtgccctgatttctatccagtgctgaataataaaccatcatcaactattggtcttgacacatctgtgaatggt

SEQ ID NO: 2247 - DNA, 253 bp, Glycine max
ccctaatgtcaagacgagttcacttagaagtttgattgaccgctccattattgagagttttggggagaaagggagaatttgtattaccagtagagtttatccctcgttggctattgacaaagatgcacatcttgatgttttcaagaatggaagccagagtgtggtgatctctgaactgaatgcttggagcatgaaggaagcagaatttagttaagaagaaagcacaattaagctgtaactaaaaagatttgga

SEQ ID NO: 2248 - DNA, 276 bp, Glycine max
  unsure (1)..(276): unsure at all n locations
cttcaaaccaagacattagcnatctagctcttgttgacattcnaatacactttggtagctatgatcatggagatcaatgcatcccccgacaacattaattcagtcaagtacaacgtacatgaaaaacagccttaccgaacttggtaccactttcagcccccacaaaattggatgaatgatccaaatggaccaatgtactacaaaggagtttaccactttttctaccaacataacccttatgcaccaacctttggtaggcatatggtatggggtcnt

SEQ ID NO: 2249 - DNA, 261 bp, Glycine max
cctagctcttgttgacattccaataactttggtgctatgatcatggagatcaatgcatcccccgacaacattaattcagtcaagtacaacgtacatgaaaaacagccttaccgaacttggtaccactttcagcccccacaaaattggatgaatgatccaaatggaccaatgtactacaaaggagtttaccactttttctaccaacataacgcttatgcaccaactttggtaggctatggtatggggtcatccgcatctatg

SEQ ID NO: 2250 - DNA, 339 bp, Glycine max
cgtccgatggattaaaggatagtcaaactgtcctaagatatgactatggaaaatattatgcctcaaaaaccatttttgaggatggaaagaacagaatggtcttattgggttgggttaatgaatcctcaagtgtttcggatgatatcaagaaaggatgggctggaatccatactattccaagggccatctggcttcataaatctggaaaacagttggtgcaatggccggtggtggaacttgaaagcttacgtgtgaatcctgtccactggcccaacaaagtggtcaaaggtggtgaaatgcttcaagttactggtgttacttgcgcacaagctgacgttg

SEQ ID NO: 2251 - DNA, 437 bp, Glycine max
  unsure (1)..(437): unsure at all n locations
cgaaaaaccatttntgaggatggaaagaacagtaaggtcttattgggttgggttaatgaatcctcaagtgtttcggatgatatcaagaaaggatgggctggaatccatactattccaagggccatctggcttcataaatctggaaaacagttggtgcaatggccggtggtggaacttgaaagcttacgtgtgaatcctgtccactggcccaccaaagtggtcaaaggtggtgaaatgcttcaagttactggtgttactgcggcacaggctgacgttgaaatttcatttgacgtgaatgagtttggaaagggcgaagtattggaccaatgggtggatccccaaattctgggtagtagaaagggtgcagccgtaaagggtggtttgggaccctatggcttgctagtttttgcttctcgtggcttgcaagagtacacggc

SEQ ID NO: 2252 - DNA, 352 bp, Glycine max
catggccgtatctccaattttgtcgttgttggctatctgctatctcatttatggcacgggtggtcttcccattgaatctacccaccatgtttacagaaatcttcagactctatcttctgattcctctgatcaaccttatagaaccgcttaccatttccaacctcccaaaaattggataaatgaccctaatggaccaatgaggtacaaatgactttatcatctcttctaccaatacaattcaaaaggtgctgtatggggtaatattgtgtggccccactcagtatcaaatgatctcgtgtattggactcctctagatcatgccatctaccctcctcaaccttatgatatcaac

SEQ ID NO: 2253 - DNA, 396 bp, Glycine max
attccattaaaagctataccatggccatatctccaattttgttgttggctatcttatctgtcatttatggcaatggtgttcttcccattgaagctacccatcatgtttacagaaatcttcagactctatcttctgattcctctgatcaaccttatagaactgcttaccatttccaacctcgcaaaaattggataaatgaccctaatggaccaatgaggtacaaaggactttaccatctgttctatcaatacaatccaaaaggtgccgtatggggcaatattgtctgggcccactcaatatcaaatgatcttgtgaattggactccactggatcatgccatctacccttctcaaccgtctgatataaacggttgttggtcaggctcagccacaatac

SEQ ID NO: 2254 - DNA, 451 bp, Glycine max
  unsure (1)..(451): unsure at all n locations
ggccgtatctccaattttgttgttgttggctatcttctctctcatttatggcaatggtattcttcccattgaagctacccaccatgtttacagaaatcttcagactctatcttctgattcctctgatcaaccttatagaaccgcttaccatttccaacctcccaaaaattggataaatgaccctaatggaccaatgaggtacaaaggactttatcatctcttctaccaatacaatccaaaaggtgctgtttggggtaatattgtgtgggcccactcagtatcaaaggatcttgtgaattggacccctctagatcatgccatctacccttctcaaccgtctgatatcaacggttgttggtcaggctcagccacaatacttcctgggggcaaaccagccattntatacacaggaattgaccctaataatcaccaagttcaaaacttagcccta

SEQ ID NO: 2255 - DNA, 283 bp, Glycine max
  unsure (1)..(283): unsure at all n locations
gttttcataggcttctnttttctcttgttgcagtnacgaacttctgaagaantggcagatncatccttngacacactctcactctttccgcganaggtttcangacaactctcactggtncacaggaacgaaattttngcccttgctgtgcaaggcttgaagccangggcaagggaatnctgcaacatgcaccaagtggttncagagtttgnagacatccctgaggagancagaaagaanctgccaagatggtgtcttggagaagttttgagntccacacagg

SEQ ID NO: 2256 - DNA, 267 bp, Glycine max
aagtcagtggtactgaccatactcatattttgcgagttccattcagatcagagtcaggaactctccgtaaatggatttcaaggtttgatgtgtggccttatctagagacttatgcagaggatgttgccagtgaaattgctgctgagttacaagggtatcctgatttcatcattggaaactacagtgatgggaatcttgttgcatctttattggcttataaaatgggagttacacagtgcacaatcgcgcatgcacttgagaagacaa

SEQ ID NO: 2257 - DNA, 264 bp, Glycine max
  unsure (1)..(264): unsure at all n locations
agtacacatggcaaatttactcacagaggcttctcactctcaaggntaganacangcttccagaagccatagacaccagtgagagtgagaagcctctggaagcnngtgtctaaccttgaccgccgtgagagccgccgctatctcgagatgtnctatgctctcaagtaccgcaaatnggccgagtcgngccccttgctgttgagtaaactgaggatgaagagncggntaaagaaatggaggaaccggctttttgtttctcattgg

SEQ ID NO: 2258 - DNA, 119 bp, Glycine max
  unsure (1)..(119): unsure at all n locations
tactgctnaacgggtattggaaatgatgcatctgctantggatattcttcaggctcctgatccttccncacaacatacgngnngccgnntngcgnncggcggngctggggggggngggc

SEQ ID NO: 2259 - DNA, 271 bp, Glycine max
  unsure (1)..(271): unsure at all n locations
gtgnnaagctcatgttatctacagctgagaattcaacttaaatggatttgaatgttcatatgtgtagtgcacaatcgcgcatgcacttgagaagacaaaatatccagattcagatttatattggaagaaatttgaggataaataccacttttcatgccaatttactgcngacctaatagccatgaattctgctgattttatcatcaccagtacataccaggagattgcnggaacgtaagtaccgttttcatgatatatatggttacttcag

SEQ ID NO: 2260 - DNA, 245 bp, Glycine max
ggcttgttgaatgctttggtaaaagctccaagctgagagagcttgtgaatcttgtggtagttggtggctacattgatgtacagaagtctacggacatagaagaaatgagggagatagagaaaatgcacaatctcatagaagaatacaacttacatggccaattccgttggataaaggcccaaatgaatcgcgctcgtaatggagagctctaccgttatattgctgatgtgaaaggtgcttttgtg

SEQ ID NO: 2261 - DNA, 98 bp, Glycine max
catgagcttgccaaagagttgcaaggtcagccagattcgattgtcggaaactacagtgatggaaacattgttgcctctttgttggcacataaattagg

SEQ ID NO: 2262 - DNA, 209 bp, Glycine max
actctatataacccacctctctttattgcgttcattctgttttactgttgaagtctttcactagccaatagccaccgatcatttgacctggttcacagtctacgtgagaggcttgatgaaaccctcactgccaacaggaatgaaatttaggcccatcagtcaaggatcgatgtcaagggcaaaggcatcatacaaaaacaccaggtcat

SEQ ID NO: 2263 - DNA, 175 bp, Glycine max
cagaattcaaaacgcagatgcactccaacatgttctgaggaaagctgaggagtatcagggcacagtgcctcctgaaactccctactcagaatttgagcacaagttccaggagattggtttggagagagggtggggtgacaacgcggaggtgatccttgagtcaattcaaattctc

SEQ ID NO: 2264 - DNA, 263 bp, Glycine max
tggtgtatagagaatgtcgtgttgctgatcattccattgggccattggaaattcgtgttgtgaggagtgggagctttaaggagcttatagatgatgcagtctcaagaggtgcggccataaatcaagaagatgtgtggcctcatcgagacctacagattgaacggccaattcagatggatatcgtctcagatgaaccgtgtgaggaacgaagagctctaccgtgtcgtctgtgacacaaggggtgcctatgtgcaactgcagtt

SEQ ID NO: 2265 - DNA, 279 bp, Glycine max
ctccgagcacaagttcgtgctgaaggacaagaagaagccgatcatcttctcgatggcgcgtctcgaccgcgtgaagaacatgacaggcctggtggagatgtacggcaagaacgcgcgcctgagggagctggcgaacctcgtgatcgtcgccggtgaccacggcaaggagtccaaggacagggaggagcaggcggagttcaagaagatgtacagcctcatcgacgagtacaagttgaagggccatatccggtggatctcggcgcagcatgaaccgcgtcc

SEQ ID NO: 2266 - DNA, 250 bp, Glycine max
agggtatcctgatttcatcattggaaactacagtgatgggaatcttgttgcatctttattggcttataaaatgggagttacacagtgcacaatcgcgcatgcacttgagaagacaaaatatccagattcagatttatattggaagaaatttgaggataaataccacttttcatgccaatttactgctgacctaatagccatgaataatgctgattttatcatcaccagtacataccaggagattgcggga

SEQ ID NO: 2267 - DNA, 52 bp, Glycine max
ggtgttcggaactgagcactcccacattcttcgagttccctttagaactgag

SEQ ID NO: 2268 - DNA, 236 bp, Glycine max
caattttgtattggagcttgattttgagccatttaatgccacatttcctcgtccaactcgctcagcatccattggcaatggtgtccaatttctcaatcgccacctttcatctattatgtttcgcaacaaggattccttgcagcccttgcttgatttcctccgagctcacaaatacaagggccatgctctgatgttaaatgatagaatacaaaccatttccaaacttcagctgcatt

SEQ ID NO: 2269 - DNA, 243 bp, Glycine max
cagattcagatttatattggaatctggatattttgtcttctcaagtgcatgcgcgattgtgcactgtgtaactcccatttgatacactcaatgaagatgcacttgagaagacaaaatatccagattcagatttatattggaagaaatttgaggataaataccacttttcatgccaatttactgctgacctaatagccatgaaaatgcgtgttttatcatcaccagtacataccaggagattgc

SEQ ID NO: 2270 - DNA, 86 bp, Glycine max
ggtgggcaggttgtttatatactagatcaagtgcgtgcccttgaaaatgagatgctccttcggatcaagaaacagggacttgattt

SEQ ID NO: 2271 - DNA, 234 bp, Glycine max
attttataatcactagtacataccaagaaattgcaggaagcaagaataatgttggacaatatgagagctacactgccttcactcttccaggactgtatcgtgttgttcatggcattgatgtttttgatcccaagtttaatatcgtgtctcctggtgcggacatgtgcatatattttccatactcggacagagaaaggagactaacttctctacatggttcaattgaaaaactgg

SEQ ID NO: 2272 - DNA, 121 bp, Glycine max
cgttcattctgttttccagttgaagtctttccacagccaatggccactgatcgtttgacccgggttcacagtctccgtgagacgcttgatgaaaccctcactgccaacaggaacgaaattt

SEQ ID NO: 2273 - DNA, 167 bp, Glycine max
cgcaacgagttcatctctcttctctccaggtatgttgctgggggcaaaggaatactacaaccacatgacctgctgtacgaggtagaaaagcttcttgaagaggatgaagggatgcagaaactcaaagatagcccttttgtcaaagagcgtgaatctcaaaggaagca

SEQ ID NO: 2274 - DNA, 221 bp, Glycine max
gaagaacttaaccgggttagttgaatggtatggcaagaacaagagactgagaaatttggtgaaccttgtcatagtaggaggcttctttgccccttcaaaatcaaaagatagggaggaaatggcagaaataaaaaatatgcatgacttaattgataagtaccaactcaagggtcaatttagatggattgctgctcagactaataggtatcgcaatggagagc

SEQ ID NO: 2275 - DNA, 166 bp, Glycine max
gtcaagggaaagactgtgatgtggaatgacagaattcaaaacccagatgcagtccaacatgtgctgaggagagctgaggagtatcgaggcacagtgcctcctgaaacgcgctactcagagtttgagcacgagggccaggagattggttagaggagagggtggggtg

SEQ ID NO: 2276 - DNA, 222 bp, Glycine max
  unsure (1)..(222): unsure at all n locations
cgtgtgaagaacatcacaggactcgtggagtggtacggtaagaacgcgaagtagagggagttggtgaaccttgtggttgttgccggagacaggaggaaggagtcgaaggacttggaagagaaggccgagatgaagaagatgtacggcctgatcgagaccaaagtgttgaacgggcaactcagantganttcagtatagagtaaccgatctaggaacggagag

SEQ ID NO: 2277 - DNA, 220 bp, Glycine max
ctttgagcagagcaaggctgatccatctcactgggcaaaaatctcccccggtggactcaagggtatcatgaggcatacacatggccaatttactcggacaggctcttgacactcactggtgtgtatcgcttctggaagcacgtgaccaatcttgaacgccgtgcgagcaaacgttacctcgagatgttctatgctctccagtaacgcaaattggctgagt

SEQ ID NO: 2278 - DNA, 169 bp, Glycine max
atgggagttacacagtgcacaatcgcgcatgcacttgagaagacaaaatatccagattcagatttatattggaagaaatttgaggataaataccacttttcatggcaatttactgctgacctaatagccatgataaatgctgatttaatcatcaccagtcattaccagg

SEQ ID NO: 2279 - DNA, 258 bp, Glycine max
  unsure (1)..(258): unsure at all n locations
ggttactttgcccaagataatgtctgagtcgtancctgacacgtggtgggcaggttgtgtacatcttaggtcaagttcgtgccttggagaatgagatgctcaaccgcatcaagacacaaggccttgatatcacgcctcgtattctcattattactcgtcttcgccctgatgcagtaggaactacctgtggccaacgtctagagaccgtatatgatactgaatattgtgacattctccgagttccttgcagaaccgaaa

SEQ ID NO: 2280 - DNA, 265 bp, Glycine max
gcagacagataaaggaatcctgcatcaatggatttctcgcttcgacatttacccctatcttgagaggtttactcaggatgcaacagccaagattcttgagttcatggaagggaaaccagatctagttattggaaattacactgatggaaatttggtagcatcactaatggctagaaaacttgggataactcagggaactatagcacatgctttagagaagaccaagtatgaagactcagatgtcaagtggcaagagttggacccc

SEQ ID NO: 2281 - DNA, 266 bp, Glycine max
  unsure (1)..(266): unsure at all n locations
gggttcaatttctcaaccgacatctgtcatcgttcatgtttcgtagcaaagaaagtttggaacctctccttgcatttcttcgcacacacagatatganggtcatgcaatgatgctaaatgancgcatttataacttatccaagctccagtcttccttggcaaaggcagaagaattactttctagactacnacccaatgcaccatattctgactttgaatatgaactacaaggattgggatttgagagcggttggggtgatacagca

SEQ ID NO: 2282 - DNA, 254 bp, Glycine max
  unsure (1)..(254): unsure at all n locations
cacaacacgggttgcctcactttactctgccgcagatgtttatgttataaactctcaggggctgggagaaacatttggacgtgtgactatagaagcaatggcgtttggtcttccggttcttgggacggacgctggaggaacacaggagattgttgagcacaatgttacaggtctcttcatcctgttggacatccggggaatcttgttcttgcanagatcccnggtttttactcaaaaaccngtgggaaaggaac

SEQ ID NO: 2283 - DNA, 152 bp, Glycine max
  unsure (1)..(152): unsure at all n locations
gctggaagcaaggacactgttggacagtacgaatctcacacagcatacaatcacccnggactctancgcgttgtgcatggtagggatgtctttgagcgagaattcaacattggctcccctggagctgatcaaaccatttacttgcccccaca

SEQ ID NO: 2284 - DNA, 224 bp, Glycine max
gcctggtgtgtgggagtactgacagcgcatgtgcacgctcttattgtagaggagttgcaacctgctgagtaccttcaattgaaggaagcacttgctgatggtagtatctaatggcgactttgtgcttgagtaggactttgaagcactcaatgcagccttctactgcgtcagctcctaacaagtcaactggagatggtgtggagtactcatgcgccacctttctg

SEQ ID NO: 2285 - DNA, 273 bp, Glycine max
tcctcttttgcgttcactctggtctcatagtgacgaacttctgaagaaatggcacatcatcctgtgacacactctcactctatccgcgacacgcttgaacccaagggcaatggaatcctgcaacatcaccaagtggttgcagagtatgaagaaatccctgaggagagcagaaagaaactccaagatggtgtctttggagaagttttgagatccacacaggaagccatagtgctgccaccacttgtagctcttgctgttcgaccaaggcctggt

SEQ ID NO: 2286 - DNA, 238 bp, Glycine max
ggaatatctgcgtgtgaatgtgtacatgcttgttgttgatgagcttcgtcctgctgagtatctgcgtttcaaggaggagcttgttgagggaagttcaaacggcaacttatgtgcttgagttggactttgaaccgtttaatgcatccttccctgcgcccaactctgaacaagtccattggaaatggcgtcgagttcctcaaccgccacctttcggccaagctcttccacacaacatacg

SEQ ID NO: 2287 - DNA, 179 bp, Glycine max
tacggctgcggaagacgacagaagggggggggttgaagatacaagggagagagacttacatgtgttcctcattctccactgagctgtaaagaagctcttcaatgtcagagtggaattctgttaacctaggctcagtttcagtgtatgggaagtatatacccatgtctgcaccgggagag

SEQ ID NO: 2288 - DNA, 293 bp, Glycine max
  unsure (1)..(293): unsure at all n locations
gcgtttcaaggaggagcttgttgagggaagttcaaacggcaactttgtgcttgagttggactttgaaccgtttaatgcatccttccctcgcccaactctgaacaagtccattggaaatggcgtcgagttcctcaaccgccacctttcggccaagctcttccatgacaaggagaaccctcagtaactgcttgagttcctcaggcttcacagttataagggaaagaccatgatgttgaacgacaaagttcaaagcctggattctctccacatangatttgagaaaagcagaagag

SEQ ID NO: 2289 - DNA, 293 bp, Glycine max
  unsure (1)..(293): unsure at all n locations
cttcttcttttacgttcattctgttttcatagtgaggatcttctnaagaaatggcaaatcaccctttgacacactctcactctttccgcgagaggtttgatgaaactctcactggtcacaggaatgaaattttggcccttttgtcaaagcttgaagccaagggcaagggaatcctgcaacaccaccaggtggttgcagagtttgaagaaatccctgaggagagcagaaagaaactccaaggtggtgtctttggagaagttttgagatctacacaggaagccatagtgctgcca

SEQ ID NO: 2290 - DNA, 267 bp, Glycine max
gatcttctgaagaaatggcaaatcaccctttgacacactctcactctttccgcgagaggtttgatccaactctcactggtcacaggaatgaaattttggcccttttgtcaaggcttgaagccaagggcaagggaatcctgcaacaccaccaggtggttgcagagtttgaagaaatccctgaggagagcagaaagaaactccaaggtggtgtctttggagaagttttgagatctacacaggaagccatagtgctgccaccatttgtgg

SEQ ID NO: 2291 - DNA, 267 bp, Glycine max
ccttccttttttgcgttcattctgttttcatagtgacgaacttctgaagaaatggcaaatcatcctttgacacactctcactctttccgcgagaggtttgatgaaactctcactggtcacaggaacgaaattttggcccttctgtcaaggcttgaagccaagggcaagggaatcctgcaacatcaccaagtggttgcagagtttgaagaaatccctgaggagagcagaaagaaactccaagatggtgtctttggagaagttttgaga

SEQ ID NO: 2292 - DNA, 268 bp, Glycine max
gatcttctgaagaaatggcaaatcaccctttgacacactctcactctttccgcgagaggtttgataaaactctcactggtcacaggaatgaaattttggcccttttgtcaaggcttgaagccaagggcaagggaatcctgcaacaccaccaggtggttgcagagtttgaagaaatccctgaggagagcagaaagaaactccaaggtggtgtctttggagaagttttgagatctacacagtaagccatagtgctgccaccatttgtggc

SEQ ID NO: 2293 - DNA, 259 bp, Glycine max
cttcaccccttccttttttgcgttcattctgttttcatagtgacgaacttctgaagaaatggcaaatcatcctttgacacactctcactctttccgcgagaggtttgatgaaactctcactggtcacaggaacgaaattttggcccttctgtcaaggcttgaagccaagggcaagggaatcctgcaacatcaccaagtggttgcagagtttgaagaaatccctgaggagagcagaaagaaactccaagatggtgtcttt

SEQ ID NO: 2294 - DNA, 257 bp, Glycine max
tccttttttgcgttcattctgttttcatagtgacgaacttctgaagaaatggcaaatcatcctttgacacactctcactctttccgcgagaggtttgatgaaactctcactggtcacaggaacgaaattttggcccttctgtcaaggcttgaagccaagggcaagggaatcctgcaacatcaccaagtggttgcagagtttgaagaaatccctgaggagagcagaaagaaactccaagatggtgtctttggagaagt

SEQ ID NO: 2295 - DNA, 279 bp, Glycine max
tagcaccccttcttcttttacgtacattctgttttcatagtgaggttcttctgaagaaatggcaaatcacgcctttgacacactctcactctttccgcgagaggtttgatgtaactctcactaggtcacaggaatgaaattttggccctttatgtcaaggcttgaagccaagggcaagggaattctgcaacaccaccaggtggttgcagagtttgaagaaatccctgaggagagcagaaagaaactccaaggtggtgtctttggagaagttttgagatc

SEQ ID NO: 2296 - DNA, 243 bp, Glycine max
caccccttcttcttttacgttcattctgttttcatagtgaggatcttctgaagaaatggcaaatcaccctttgacacactctcactctttccgcgagaggtttgatgaaactctcactggtcacaggaatgaaattttggcccttttgtcaaggcttgaagccaagggcaagggaatcctgcaacaccaccaggtggttgcagagtttgaagaaatccctgaggagagcagaaagaaactcca

SEQ ID NO: 2297 - DNA, 244 bp, Glycine max
cttcttcttttacgttcattctgttttcatagtgaggatcttctgaagaaatggcaaatcaccctttgacacactctcactctttccgcgagaggtttgatgaaactctcactggtcacaggaatgaaattttggcccttttgtcaaggcttgaagccaagggcaagggaatcctgcaacaccaccaggtggttgcagagtttgaagaaatccctgaggagagcagaaagaaactccaaggtgg

SEQ ID NO: 2298 - DNA, 281 bp, Glycine max
  unsure (1)..(281): unsure at all n locations
ccttcaccccttccttttttgcgttcattctgttttcatagtgacgaacttctgaaganatggcaaatcatcctttgacacactctcactgctttccgcgagaggtttgatgaaactctcactggtcacaggaacganattntggnccttctgtcaaggcttgaagccaagggcaagggatcctgcnacatcaccaagtggttgcagagtttgaagngatccctgaggagagnaganacnnatcccaggatggtgtctttggagaagtnttgagatccaca

SEQ ID NO: 2299 - DNA, 268 bp, Glycine max
attttccccttcaacccttccttttttgcgttcattctgttttcatagtgacgtacttctgatgaaatggcaaatcatcctttgacacactctcactctttccgcgagaggtttgatttaactctcactggtcacaggaacgaaattttggtccttctgtcaaggcttgaagccaagggctagggaatcctgcaacatcaccaagtggttgcagagtttgaagaaatccctgaggagagcagaaagaaactccaagatggtgtctttg

SEQ ID NO: 2300 - DNA, 346 bp, Glycine max
ctcattctattttcatagtgacgaacttctgaagaaatggcaaatcatcctttgacacactctcactctttccgcgcgaggtctgatgaaactctcactggtcacaggaacgaaattctagcccttctgtcaagagctgaacccaagggcaagggaatcctgcaacatcaccaagtggttgcagagtttgacgaaatccctgaggcgagcagaaagaaactccaagatgatgtctttcgagcaattttgagatccacacaggaagccataatgctaccaccatttgtagctcttgctgttcgaccatggcctcgtgtatgggactatctgcgtgtgaatgtgcaca

SEQ ID NO: 2301 - DNA, 245 bp, Glycine max
gaagaaatggcaaatcatcctttgacacactctcactctttccgcgagaggtttgatgaaactctcactggtcacaggaacgaaattttggcccttctgtcaaggcttgaagccaagggcaagggaatcctgcaacatcatcaagtggttgcagagtttgaagaaatccctgaggagagcagaaagaaactccaagatggtgtctttggagaagttttgagatccacacaggaagccatagtgct

SEQ ID NO: 2302 - DNA, 233 bp, Glycine max
ttccccttcaccccttccttttttgcgttcattctgttttcatagtgacgaacttctgaagaaatggcaaatcatcctttgacacactctcactctttccgcgagaggtttgatgaaactctcactggtcacaggaacgaaattttggcccttctgtcaaggcttgaagccaagggcaagggaatcctgcaacatcaccaagtggttgcagagtttgaagaaatccctgagga

SEQ ID NO: 2303 - DNA, 262 bp, Glycine max
  unsure (1)..(262): unsure at all n locations
attctgttttcatagtgacgaacttctgaagaaatggcaaatcatcctttgacacactctcactctttccgcgagaggtttgatgtanatctcactggtcacaggaacgaaattttggcccttctgtcaaggcttgaagccaagggcaagggaatcctgcaacatcaccaagtggttgcagagtttgaagaaatccctgaggagagcagaaagaaactccaagatggtgtctttggagaagttttgagatccacacaacata

SEQ ID NO: 2304 - DNA, 260 bp, Glycine max
ttcaccccttccttttttgcgtacattctgttttcataggcttcttttttctcttgttgcagtgacgaacttctgaagatatggcaaatcatcctttgacacactctcactctttccgcgagaggtttgatggaactctcactggtcacaggaacgaaattttggcccttctgtcaaggcttgaagccaatggtaagggaatcctgcaatatcatcaagtggttgcagagtttgaagaacatccctaacgagagcagaaa

SEQ ID NO: 2305 - DNA, 249 bp, Glycine max
cccttccttttttgcgttcattctgttttcatagtgacgaacttctgaagaaatggcaaatcatcctttgacacactctcactctttccgcgagaggtttgatgaaactctcactggtcacaggaacgaaattttggcccttctgtcaaggcttgaagccaagggcaagggaatcctgcaacatcaccaagtggttgcagagtttgaagaaatccctgaggagagcagaaagaaactccaagatggtgt

SEQ ID NO: 2306 - DNA, 265 bp, Glycine max
ttgcaccctgcctgttttgcgtgcattctgtcttcatagtgacgaacttctggagaaatggcaaatcatcctttgacacactctcactctttccgcgagaggtttgatgagactctcactggtcacatgaacgagattattgcccttctgtcaaggcttgaagccaagggcaagggaatcctgcaacatcaccaagtggttgcagagtttgaagaaatccctgaggagagcagaaagagactccgagatggtgccttggagaagt

SEQ ID NO: 2307 - DNA, 255 bp, Glycine max
ccccttcaccccttcttcttttacgttcattctgttttcatagtgaggatcttctgaagaaatggcaaatcaccctttgacacactctcactctttccgcgagaggtttgatgaaactctcactggtcacaggaatgaaattttggcccttttgtcaaggcttgaagccaagggcaagggaatcctgcaacaccaccaggtggttgcagagtttgcagaaatccctgaggagagcagaaaaaactccaaggtggt

SEQ ID NO: 2308 - DNA, 157 bp, Glycine max
cactctcactctttccgcgagaggtttgatgtaactctcactggtcacaggaatgaaattttggcccttttgtcaaggcttgaagccaagggcatgggaatccttcaacaccaccaggtggttgcagagtttgaagaaatccctgaggagagcagaa

SEQ ID NO: 2309 - DNA, 236 bp, Glycine max
cttcaccccttccttttttgcgttcattctgttttcatagtgacgaacttctgaagaaatggcaaatcatcctttgacacactctcactctttccgcgagaggtttgatgaaactctcactggtcacaggaacgaaattttggcccttctgtcaaggcttgaagccaagggcaagggaatcctgcaacatcaccaagtggttgcagagtttgaagaaatccctgaggagagcagaa

SEQ ID NO: 2310 - DNA, 312 bp, Glycine max
  unsure (1)..(312): unsure at all n locations
gctccgcattcggctcgagcatatacgttcattcactgntcatagtgaggatcctctgaagaaatggcaactcaccctttgacacactcacactccttccgcgagaggtatgatccaactctcactggtcacaggaatgcaatcatggccctaatgtccaggcttgaagccaagggcaagggcatcctgcaacaccaccaggtggttgcagagtttgaagaaatccctgaggagagcagaaagacactccaaagtggtgtctttggagaagttttgacctctacacatgaagccatcccgctgccaccattt

SEQ ID NO: 2311 - DNA, 147 bp, Glycine max
ccccttcaccccttcttcttttacgttcattctgttttcatagtgaggatcttctgaagaaatggcaaatcaccctttgacacactctcactctttccgcgagaggtttgatgaaactctcactggtcacaggaatgaaattttggc

SEQ ID NO: 2312 - DNA, 241 bp, Glycine max
ttccccttcaccccttccttttttgcgttcattctgttttcatagtgacgaacttctgaagatatggcaaatcatcctttgacacactctcactctttccgcgagaggtttgatgaaactctcactggtccaggaacgaaattttggcccttctgtcaaggcttgaagccaagggcaagggaatcctgcaacatcaccaagtggttgcagagtttgaggaatcccctgaggaagccaaaaa

SEQ ID NO: 2313 - DNA, 206 bp, Glycine max
cccttcttcttttgcgttcattctgttttcatagtgatgatcttcttgaataatggcaaatcaccctttgacacactctcactctttccgcgagaggtttgatgaaactctcactggtcacaggaatgaaattttgggccgtttgtcaatgcttgaagccaacggcatcggaatcctgtaccactaccaggtggatgaatattttg

SEQ ID NO: 2314 - DNA, 299 bp, Glycine max
ccctactctgaaaagcagaacagacttacagccctgcatggttcaattgaacagctattatttgctcctgagcagactgatgaatacattggtttattgaaagacaagtcaaagcccataattttctccatggcaaggctagacagagtaaaaaacataactggattggtagaaagctttggtaagaacagcaaattgagggaactggtcaaccttgtcatagtagctggttatattgatgtaaagaagtccagtgacagagaagaaattgcagaaattgagagatgcatgagctcatg

SEQ ID NO: 2315 - DNA, 271 bp, Glycine max
gcagaacaggcttacagccctgcatggttcaattgaaaagctgttatttgatcctgagcagactgatgaatacattggttcattgaaagacaagtcaaagcccataattttctccatggcaaggctagacagagtgaaaaacataactggattggtagaatgctttggtaagaacagcaaattgagggaactggtcaaccttgttgtagtagctggttatattgatgtaaagaagtcgagtgacagagcagaaatggcagaaattgagaag

SEQ ID NO: 2316 - DNA, 235 bp, Glycine max
gtttattgaaagacaagtcaaagcccataattttctccatggcaaggctagacagagtaaaaaacataactggattggtagaaagctttggtaagaacagcaaattgagggaactggtcaaccttgtcatagtagctggttatattgatgtaaagaagtccagtgacagagaagaaattgcagaaattgagaagatgcatgagctcatgaaaaagtataacttagttggtgattt

SEQ ID NO: 2317 - DNA, 241 bp, Glycine max
gcagaacaggcttacagccctgcatggttcaattgaaaagctgttatttgatcctgagcagactgatgaatacattggttcattgaaagacaagtcaaagcccataattttctccatggcaaggctagacagagtgaaaaacataactggattggtagaatgctttggtaagaacagcaaattgagggaactggtcaaccttgttgtagtagctggttatattgatgtaaaaagtcgagtg

SEQ ID NO: 2318 - DNA, 261 bp, Glycine max
agtatgagagccacgctggttttactcttcctgggctctatagggttgtccatggcattgatgtttttgatcccaagttcaatattgtctctcctggagctgatatgtcaatatatttcccctactctgaaaagcagaacagacttacagccctgcatggttcaattgaacagctattatttgctcctgagcagactgatgaatacattggtttattgaaagacaagtcaaagcccataattttctccatggcaaggctag

SEQ ID NO: 2319 - DNA, 258 bp, Glycine max
atcaccagtacataccaggagattgctggaacgaaaaatactgttggccagtatgagagccacgctggttttactcttcctgggctctatagggttgtccatggcatgatgtttttgatcccaagttcaatattggtctctcctgggagctgatatgtcaatatatttcccctactctgaaaagcagaacagacttacagccctgcatggttcaattgaacagctattatttgctcctgagcagactgatgaatacat

SEQ ID NO: 2320 - DNA, 229 bp, Glycine max
acctaatagccatgaataatgctgattttatcatcaccagtacataccaggagattgcaggaacgaaaaatactgttggccagtatgagagccacgctggttttactcttcctgggctctatagggttgtccatggcattgatgtttttgatcccaagttcaatattgtctctcctggagctgatatgtcaatatatttcccctactctgaaaagcagaacagacttac

SEQ ID NO: 2321 - DNA, 222 bp, Glycine max
tgctgattttatcatcaccagtacataccaggagattgcaggaacgaaaaatactgttggccagtatgagagccacgctggttttactcttcctgggctctatagggttgtccatggcattgatgtttttgatcccaagttcaatattgtctctcctggagctgatatgtcaatatatttcccctactctgaaaagcagaacagacttacagccctgcatgg

SEQ ID NO: 2322 - DNA, 252 bp, Glycine max
cgcacttgagttttataaataatgtccgtgattttagtatttttaccttctctttctctcctcttatcgaaagcttaatcacaaaactaaaatcacggacattatttataaaactcaagtgcgacaaactccaaatgagaaagaaaaagccggtgattttagttttgtgattaagctttcgataagaagtgagaaagagaaggaaaaaaaaagttgcttttgtttatgtacgtaccatgatttggaccttaa

SEQ ID NO: 2323 - DNA, 109 bp, Glycine max
cgcacttgagttttataaataatgtccgtgattttagttttgtcgccttctctttctctcctcttatcgaaagcgtaatcacaaaactaaaatcacggacattatttat

SEQ ID NO: 2324 - DNA, 262 bp, Glycine max
cataatttgattgatgaacttgacaacatccctggcgatgatcaagcaatagtggatcttaaaaatggtccctttggtgaaatcgtcaagtctgcaaaggaagccatagttttgcctccttttgtggcaatagcagttcgtccaagacctggtgtttgggaatatgtccgtgttaatgtctctgagctcagcgtggagcaattaagtgtttctgaatatctcagcttcaaggaagaacttgtagatggaaagattaatgaca

SEQ ID NO: 2325 - DNA, 272 bp, Glycine max
ctctcatgcttttttccacttgcaaactccaaattcactctgacagtttttgcagctaattaagaagaacttaacagacatataaacatagtgatcgttatgtctacgcaaccaaagcttggtcggattcccagtatcaagaccgagttgaagacactctctctgctcaccgtaacgaactcatttctctcctctccaggtatgtggctcaggggagatggattttgcaaccccataatttgattgatgaacttgacaacatccctggcgat

SEQ ID NO: 2326 - DNA, 264 bp, Glycine max
ctttaactcatgctttttcccacttgcaaactccaaattcactctctgacagtttttgcagccaattaagaagaacttaacagacatataaacatagtgatcgtcatgtctacgcaaccaaagcttggtcggatttccagtatcagagaccgagttgaagacactctctctgctcaccgtaacgaactcatttctctcatctccaggtatgtggctcaggggaaagggattttgcaaccccataatttgattgatgaacttgac

SEQ ID NO: 2327 - DNA, 189 bp, Glycine max
gctttttcccacttgcaaactccaaattcactctctgacagtttttgcagctaattaagaagaacttaacagacatataaacatagtgatcgtcatgtctacgcaaccaaagcttggtcggatttccagtatcagagaccgagttgaagacactctctctgctcaccgtaacgaactcatttctctcct

SEQ ID NO: 2328 - DNA, 279 bp, Glycine max
gcatgcagccactgcttgagttcctcaggcttcacagttataagggaaagaccatgatgttgaatgacaaagttcaaagcctggattctctccaacatgttttgagaaaagcagaagagtatctgatttcagttgctcctgaaacaccctactcggaattcgagaacagattccgggagattggtctggagagggggtggggtgacactgccgagcgtgtcctcgagatgatccagcttctcctggaccttcttgaggcacctgacccttgcaccctcg

SEQ ID NO: 2329 - DNA, 286 bp, Glycine max
gagagtatgcagccactgcttgaattcctcaggcttcacagttataagggaaagaccatgatgttgaatgacaaagttcaaagcctggattctctccagcatgttttgagaaaagcagaagagtatctgacttcagttgctcctgaaacaccctactcagaattcgagaacaaattccgggaaattggtttggagagggggtggggtgacatcgccgagcgtgtcctcgagatgatccagcttctcttggaccttcttgaggcacccgacccttgctacctcgaga

SEQ ID NO: 2330 - DNA, 269 bp, Glycine max
agcaactctgaacaagtccattggaaatggcgtcgagttcctcaaccgccacctttcggccaagctcttccatgacaaggagagcatgcagccactgcttgagttcctcaggcttcacagttataagggaaagaccatgatgttgaatgacaaagttcaaagcctggattctctccaacatgttttgagaaaagcagaagagtatctgatttcagttgctcctgaaacaccctactcggaattcgaaaacagattccgggagattggtc

SEQ ID NO: 2331 - DNA, 267 bp, Glycine max
  unsure (1)..(267): unsure at all n locations
gcatgcagccactgcttgagttcctcaggcttcacagttataagggaaagaccatgatgttgaatgacaaagttcaaagcctggattctctccaacatgttttgagaaaagcagaagagtatctgatttcagttgctcctgaaacaccctaactcggaattcgagaaacagattccgggagattggtctggagagggggtggggtgacatgncgancgtgtcctcgagatgatccagttctctggacttcttgangcactgaccttg

SEQ ID NO: 2332 - DNA, 152 bp, Glycine max
tgcagccactgcttgaattcctcaggcttcacagttataagggaaagaccatgatgttgaatgacaaagttcaaagcctggattctctccagcatgttttgagaaaagcagaagagtatctgacttcagttgctcctgaaacaccctactca

SEQ ID NO: 2333 - DNA, 271 bp, Glycine max
ctctccaacatgttttgagaaaagcagaagagtatctgatttcagttgctcctgaaacaccctactcggaattcgagaacagattccgggagattggtctggagaggtggtggggtgacactgccgagcgtgtcctcgagatgatccagcttctcctggaccttcttgatgcacctgacccttgcaccctcgagacattccttggaagagtccctatggtctataatgttgttacctttctccccatggttactttgcccaagataatgtc

SEQ ID NO: 2334 - DNA, 265 bp, Glycine max
ctccaacatgtgttgagaaaagcagaagagtatctgatttcagttgctcctgaaacaccctactcggaattcgagaacagattccgggagattggtctggagagggggtggggtgacactgccgagcgtgtcctcgagatgatccagcttctcctggaccttcttgaggcacctgacccttgcaccctcgaatcattccttggaagagtccctatggtcttcaatgttgttatcctttctccccatggttactttgcccaagata

SEQ ID NO: 2335 - DNA, 243 bp, Glycine max
tgctgagatcattgagcatggtatatcaggattccacattgatccttatcatcctgatcaagcttcagagctattggttgaatttttccaaaagagcaaggaggacccagaccattggaagaaaatatctaatggtggtcttcaaagaatttatgaaaggtacacttggaagatttattctgaaaggcttatgacctttgcgggagtttatagtttctggaaatacgtttccaaattagagag

SEQ ID NO: 2336 - DNA, 251 bp, Glycine max
gctacttgccatggtggtccggctgagatcattgagcatggtatatcaggattccacattgatccttatcaccctgatcaagcttcacagctattagttgaatttttccaaaagagcaaggaggacccaagccattggaagaaaatatctgatggtggtcttcaaagaatttatgaaaggtacacgtggaagatttattccgaaaggcttatgactttggcgggagtttatagtttctggaaatacgtttc

SEQ ID NO: 2337 - DNA, 244 bp, Glycine max
ggagttacccagtgcacaatcgcgcatgcacttgagaagacaaaatatccagattcagatttatattggaagaaatttgaggataaataccacttttcatgccaatttactgctgacctaatagccatgaataatgctgattttataatcaccagtacataccaggagattgcaggaacgaaaatactgttggccagtatgagagtcacactggttttactcttcctgggctctatagggttgt

SEQ ID NO: 2338 - DNA, 241 bp, Glycine max
gcacaatcgcgcatgcacttgagaagacaaaatatccagattcagatttatattggaagaaatttgaggataaataccacttttcatgccaatttactgctgacctaatagccatgaataatgctgattttatcatcaccagtacataccaggagattgcaggaacgaaaaatactgttggccagtatgagagccacgctggttttactcttcctgggctctatagggttgtccatggcat

SEQ ID NO: 2339 - DNA, 265 bp, Glycine max
cttctttgagaagtgcaagcttgacccaactcactgggacaagatctcaaaggctggtctccagcgtattgaagagaagtacacatggcaaatttactctcagaggcttctcactctcaccggtgtctatggcttctggaagcatgtgtctaaccttgaccgccgtgagagccgccgctatctcgagatgttctatgctctcaagtaccgcaaattggctgagtctgtgccccttgctgctgagtaaactgaggataaagagttg

SEQ ID NO: 2340 - DNA, 258 bp, Glycine max
ggctggtctccagcgtattgaagagaagtacacatggcaaatttactctcagaggcttctcactctcaccggtgtctatggcttctggaagcatgtgtctaaccttgaccgccgtgagagccgccgctatctcgagatgttctatgctctcaagtaccgcaaattggctgagtctgtgccccttgctgctgagtaaactgaggataaagagttggataaagaaatggaggaaccggctttttctttgtacattggagt

SEQ ID NO: 2341 - DNA, 276 bp, Glycine max
gaagtcttgagatctacacaggaagccatagttttgccaccatgggttgctctggctgttcgtccaagacctggtgtgtgggagtacctgagagtgaatgtgcacgctcttgttgttgaggagttgcaacctgctgagtacctgcacttcaaggaagaacttgttgacggaagttctaatggcaactttgtgcttgagttggactttgaaccattcaatgcagccttcccccgcccaacccttaacaagtcaattggaaatggtgtgcaattcctc

SEQ ID NO: 2342 - DNA, 284 bp, Glycine max
  unsure (1)..(284): unsure at all n locations
caggaagcnatagttttgccaccatgggttgctctggctgttcgtccaagacctggtgtgtgggagtacctgagagtgaatgtgcacgctcttgttgttgaggagttgcaacctgctgagtacctgcacttcaaggaagaanttgttgacggaagttctaatggcaactttgtgcttgagttggatcttgaaccattgcaatgcagccttcccccgcncaantncttaacaagtcantggaaatggtgtgcaatcctcaaccgtcaccttctgccaaactctcc

SEQ ID NO: 2343 - DNA, 245 bp, Glycine max
  unsure (1)..(245): unsure at all n locations
gaaaaagtataacttagttggtgattntcgttggattgctgcccaaacaaatagggcacgtaatggggagctgtatcgctacatagcagacacacaaggtgctttcgttcagcctgctttctatgaagcttttggacttacagttgtggaggccatgaattgtggactccccacttntgctacttgccatggtggtccggctgagatcattgagcatggtatatcaggattccacattgatcctt

SEQ ID NO: 2344 - DNA, 191 bp, Glycine max
ggtgctttcgttcagcctgctttctatgaagcttttggacttacagttgtggaggccatgaattgtggactccccacttttgctacttgccatggtggtccggctgagatcattgagcatggtatatcaggattccacattgatccttatcaccctgatcaagcttcacagctattagttgaatttttcca

SEQ ID NO: 2345 - DNA, 257 bp, Glycine max
  unsure (1)..(257): unsure at all n locations
ctctccatggttactttgcccaagataatgtcttggggtacctgacactggtggacaggttgtttacatcttggatcgagttcgtgccttggagaatgagatgctcaaccgcatcnagaaacaaggccttgatatcacccctcgtattctcattattactcgtcttctccctgatgcagtaggaactacctgtggccaacgtctagagaggtatatgatactgaatattgtgacattctccgagttcctttcagaac

SEQ ID NO: 2346 - DNA, 218 bp, Glycine max
gtcttgggataccctgacactggtggacaggttgtttacatcttggatcaagttcgtgccttggagaatgagatgctcaaccgcatcaagaaacaaggccttgatatcacccctcgtattctcattatcactcgtcttctccctgatgcagtaggaactacctgtggccaacgtctagagagggtatatgatactgaatattgtgacattctcagagt

SEQ ID NO: 2347 - DNA, 253 bp, Glycine max
ggattccttgcagcccttgcttgatttcctccgagctcacaaatacaagggccatgctctgttgttaaatgatagaatacaaaccatttccaaacttcagtctgcattggccaaggctgaggattatctctctaagcttgcacatgatacactctattcagagtttgaatatgtattgcaaggcatgggttttgagagaggttggggtgctactgctgaacgggtattggagatgatgcatctgctattggat

SEQ ID NO: 2348 - DNA, 311 bp, Glycine max
tcgaacgagatgaagaagatgtacggcctgatcgagacctacaagttgaacggccaattcagatggatttcatcgcagatgaaccgtgtgaggactggagagctctaccgcgtgatctgcgacaccaggggtgctttcgtgcagcctgctgtatacgaggcttttggtttgacagtggttgaggccatgacttgcggcttgccaacattcgccacatgcaatggtggtcctgctgagatcattgtgcacggcaagtctggcttccacattgacccttaccatggtgaccgtgctgctgatctccttgttga

SEQ ID NO: 2349 - DNA, 342 bp, Glycine max
tggagctttcgtgcagccggctatatacgaggcttttcgtttgacagtggttgaggccatgacttgtgggttgccaacattcgccacatgcaatggtggtcctgctgagatcattgtgcatggcaagtctggcttccacattgacccttaccatggtgaccgtgctgctgatctccttgttgacttctttgagaagtgcaagcttgacccaacccactgggaaacaatctcaaaggctggtctccagcgtattgaagagaagtacacatggcaaatttactcacagaggcttctcactctcactggtgtctatggcttctggaagcatgtgtctaaccttga

SEQ ID NO: 2350 - DNA, 305 bp, Glycine max
  unsure (1)..(305): unsure at all n locations
gcactccaacatgttctgaggaaagctgaggagtatctgggcacagtgcctnctgaaactccctactcagaatttgagcncaagttccaggagattngtttggngagagggtggggtgacaacgcggaggtgtgccttgagtcaattcaacttctcttggatcttcttgaggcccctgacccgtgcacccttgagactttccttggaagaatccctatggtgttcaatgttgttattcnttctccccatggttactttgcccaagataatgtcttnggataccctgacactggtggccaggttgt

SEQ ID NO: 2351 - DNA, 277 bp, Glycine max
ctgttggacagtacgaatctcacacagccttcacccttcctggactctaccgcgttgtgcatggtattgatgtctttgatccaaaattcaacattgtctcccctggagctgatcaaaccatttacttcccccacactgaaaccagccgtaggttgacatccttccaccctgaaatcgaagaactcctttacagctcagtggagaatgaagaacacatatgtgtgctgaaggaccgcagcaagccaattatcttcaccatggcaaggttggatcgagt

SEQ ID NO: 2352 - DNA, 278 bp, Glycine max
caatgttgttattctttctccccatggttaccctgcccaagataatgtcttgggataccctgacactggtggccaggttgtttacatcttggatcaagttcgtgctttggagaatgagatgctccatcgcattaagcaacaaggattggacattgttcctcgtattctcattatcacccgtcttctccccgatgcagtaggaactacttgtggccaacgtcttgagaaggtgttcggaactgagcactcccacattcttcgagttccctttagaactg

SEQ ID NO: 2353 - DNA, 273 bp, Glycine max
gccatgaaccacacagatttcattatcaccagtaccttccaggagattgctggaagcaaggacactgttggacagtacgaatctcacacagccttcacccttcctggactctaccgcgttgtgcatggtattgatgtctttgatccaaaattcaacattgtctcccctggagctgatcaaaccatttacttcccccacactgaaaccagccgtaggttgacatccttccaccctgaaatcgaagaactcctttacagctcagtggagaatgaa

SEQ ID NO: 2354 - DNA, 283 bp, Glycine max
caaattcaacattgtctcccctggagctgatcaaaccatttacttcccccacactgaaaccagccgtaggttgacatccttccaccctgaaatcgaagaactcctttacagctcagtggagaatgaagaacacatatgtgtgctgaaggaccgcagcaagccaattatcttcaccatggcaaggttggatcgagtgaagaacatcacaggacttgtggagtggtacggtaagaacgcgaactgagggagctggtgaaccttgtggttgttgctggagacagga

SEQ ID NO: 2355 - DNA, 271 bp, Glycine max
  unsure (1)..(271): unsure at all n locations
ggcttttggtttgacagtggttgangccatgacttgcggcttgccancnttcgccacatgcaatggtggtcctgctgagatcattgtgcacggcaagtctggcttccacattgacccttaccatggtgaccgtgctgctgatctccttgttgacttctttgagaagtgcaagcttgacccaactcactgggacaagctctcaaaggctggtctccagcgtattgaagagaagtacacatggcaaatttactctcagaggcttctcactctc

SEQ ID NO: 2356 - DNA, 273 bp, Glycine max
ctgaaatcgaagaactcctttacagctcagtggagaatgaagaacacatatgtgtgctgaaggaccgcagcaagccaattatcttcaccatggcaaggttggatcgagtgaagaacatcacaggacttgtggagtggtacggtaagaacgcgaactgagggagctggtgaaccttgtggttgttgctggagacaggaggaaggagtcaaaggacttggaagaaaaggccgagatgaagaagatgtacggcctgatcgagacctacaagttgaa

SEQ ID NO: 2357 - DNA, 278 bp, Glycine max
atcaaaccatttacttcccccacactgaaaccagccgtaggttgacatccttccaccctgaaatcgaagaactcctttacagctcagtggagaatgaagaacacatatgtgtgctgaaggaccgcagcaagccaattatcttcgccatggcaaggttggatcgagtgaagaacatcacaggacttgtggagtggtacggtaagaacgcgaagctgagggagctggtgaaccttgtggttgttgctggagacaggaggaaggagtcaaaggacttggaa

SEQ ID NO: 2358 - DNA, 325 bp, Glycine max
aggagtcgaaggacttggaagagaaggccgagatgaagaagatgtatggcctcatcgagacctacaagttgaacggccaattcagatggatatcctctcagatgaaccgtgtgaggaacggagagctctaccgtgtcatctgtgacacaaggggtgcctttgtgcagcctgcagtttatgaggcctttgggttgactgtggttgaggccatgacttgtgggttgccaacgtttgccacatgcaatggtggtcctgctgagatcattgtgcatggaaaatctggttaccacattgatccttaccatggtgaccatgctgctgagat

SEQ ID NO: 2359 - DNA, 274 bp, Glycine max
ggccatacttggaaacttacactgaggatgttgctcatgagcttgccaaagagttgcaaggcaagccagatctgattgtcggaaactacagtgatggaaacattgttgcctctttgttggcacataaattaggagtcactcaggtaccattgctcatgcacttgagaagaccaaataccccgaatccgacatttactggaaaaaattggaagagagataccacttctcttgccaattcacagctgatctatttgccatgaaccacacagatttc

SEQ ID NO: 2360 - DNA, 276 bp, Glycine max
gccaattcagatggatttcatcgcagatgaaccgtgtgaggaatggagagctctaccgcgtgatctgcgacaccaggggtgctttcgtgcagcctgctgtatacgaggcttttggtttgacagtggttgaggccatgacttgcggcttgccaacattcgccacatgcaatggtggtcctgctgagatcattgtgcacggcaagtctggcttccacattgaccctaccatggtgaccgtgctgctgatctcctgttgacttctttgagaagtgcaag

SEQ ID NO: 2361 - DNA, 267 bp, Glycine max
ccgatgcagtaggaactacttgtggccaacgtcttgagaaggtgttcggaactgagcactcccacattcttcgagttcgctttagaactgagaagggaattgttcgcaagtggatctcaagattcgaagtctggccctacttggaaacttacactgaggatgttgcccacgagcttgccaaagagttgcaaggcaagccagatctgattgttggaaactacagtgatggaaacattgtcgcttctttgttggcacataaattaggtg

SEQ ID NO: 2362 - DNA, 263 bp, Glycine max
ccaagatgtaaacaacctggatcaagttcgtgctttggagaatgagatgctccatcgcattaagcaacaaggattggacattgttcctcgtattctcattatcacccgtcttctccccgatgcagtaggaactacttgtggccaacgtcttgagaaggtgttcggaactgagcactcccacattcttcgagttccctttagaactgagaagggaattgttcgcaagtggatctcaagattcgaagtctggccctacttggaaa

SEQ ID NO: 2363 - DNA, 265 bp, Glycine max
actcagtgtaccattgctcacgcacttgagaagaccaaataccccgaatccgacatttactggaaaaaattggaagagagataccacttctcttgccaattcacagctgatctatttgccatgaaccacacagatttcattacaagcagtaccttccaggagattgctggaagcaaggacactgttggacagtacgaatctcacacagccttcacccttcctggactctaccgcgttgtgcatggtattgatgtctttgatccaa

SEQ ID NO: 2364 - DNA, 328 bp, Glycine max
gctcaaccgcatcaagaaacaaggccttgatatcacccctcgtattctcattattactcgtcttctccctgatgcagtaggaactacctgtggccaacgtctagagagggtatatgatactgaatattgtgacattctccgagttcctttcagaaccgaaaagggaattgttcgcaaatggatctcaagattcgaagtctggccatacctagagacttacactgaggatgttgcccttgaacttgccaaggagttgcaagccaagccagatctgatcgttggaaactacagtgatggaaacattgttgcctctttgttagcacataaa

SEQ ID NO: 2365 - DNA, 340 bp, Glycine max
  unsure (1)..(340): unsure at all n locations
ccatggttgaggccatgacttgcggcttgccaacattcgccacatgcaatggtggtcctgctgagatcattgtgcacggcnagtctggcttccacattgacccttaccatggtgaccgtgctgctgatctcctgttgacttctttgagaagtgcaagcttgacccaactcactgggacaagatctcaaaggctggtctccagcgtattgaagagaagtacacatggcaaatttactctcagaggttctcatctcaacggtgtctatggttctggaagcatgtgtctaacttgaacgcgtgagancgcgtatctgagagtctagtctcagtacgnaatggt

SEQ ID NO: 2366 - DNA, 273 bp, Glycine max
catgagcttgccaaagagttgcaaggcaagccagatctgattgtcggaaactacagtgatggaaacattgttgcctctttgttggctcataaattaggagtcactcagtgtaccattgctcatgcacttgagaagaccaaataccccgaatccgacatttactggaaaaaattggaagagagataccacttctcttgccaattcacagctgatctatttgccatgaaccacacagatttcattatcaccagtaccttccaggagattgctgga

SEQ ID NO: 2367 - DNA, 262 bp, Glycine max
gtggtacggtaagaacgcgaactgagggagctggtgaaccttgtggttgttgctggagacaggaggaaggagtcaaaggacttggaagaaaaggccgagatgaagaagatgtacggcctgatcgagacctacaagttgaacggccaattcagatggatttcatcgcagatgaaccgtgtgaggaatggagagctctaccgcgtgatctgcgacaccaggggtgctttcgtgcagcctgctgtatacgaggcttttggtttga

SEQ ID NO: 2368 - DNA, 263 bp, Glycine max
gtggtacggtaagaacgcgaagctgagggagctggtgaaccttgtggttgttgctggagacaggaggaaggagtcaaaggacttggaagaaaaggccgagatgaagaagatgtacggcctgatcgagacctacaagttgaacggccaattcagatggatttcatcgcagatgaaccgtgtgaggaatggagagctctaccgcgtgatctgcgacaccaggggtgctttcgtgcagcctgctgtatacgaggcttttggtttga

SEQ ID NO: 2369 - DNA, 255 bp, Glycine max
ctggaaaatattggaagagagataccacttctcttgccaattcacagctgatctatttgccatgaaccacacagatttcattatcaccagtaccttccaggagattgctggaagcaaggacactgttggacagtacgaatctcacacagccttcacccttcctggactctaccgcgttgtgcatggtattgatgtctttgatccaaaattcaacattgtctcccctggagctgatcaaaccatttacttccccca

SEQ ID NO: 2370 - DNA, 251 bp, Glycine max
cttggaagaaaaggccgagatgaagaagatgtacggcctgatcgagacctacaagttgaacggccaattcagatggatttcatcgcagatgaaccgtgtgaggaatggagagctctaccgcgtgatctgcgacaccaggggtgctttcgtgcagcctgctgtatacgaggcttttggtttgacagtggttgaggccatgacttgcggcttgccaacattcgccacatgcaatggtggtcctgctgagatca

SEQ ID NO: 2371 - DNA, 262 bp, Glycine max
ccgtcttctccccgctgcagtaggaactacttgtggccaacgtcttgagaaggtgttcggaactgagcactcccacattcttcgagttccctttagaactgagaagggaattgttcgcaagtggatctcaagattcgaagtctggccctacttggaaacttacactgaggatgttgcccacgagcttgccaaagagttgaaggcaagccagatctgattgttggaaactacagtgatggaaacattgtcgcttctttgttgg

SEQ ID NO: 2372 - DNA, 277 bp, Glycine max
cttgaggcccctgacccttgcacccttgagactttccttggaagaattcctatggtcttcaatgttgtcattctttctccccatggttactttgcccaagataatgtcttgggccaccctgacactggtggccaggttgtttacatcttggatcaagttcgtgctttggagaacgagatgctccatcgcattaagcaacaaggattggacattgtacctcgtattctcattatcaccgtcttctccccgatgcaatcggaactacttgtggccaacg

SEQ ID NO: 2373 - DNA, 255 bp, Glycine max
tggaatggagagctctaccgcgtgatctgcgacaccaggggtgctttcgtgcagcctgctgtatacgaggcttttggtttgacagtggttgaggccatgacttgcggcttgccaacattcgccacatgcaatggtggtcctgctgagatcattgtgcacggcaagtctggcctccacattgacgcttaccatggtgaccgtgctgctgatctccttgttgacttctttgagaagtgcacgcttgacccaactcac

SEQ ID NO: 2374 - DNA, 269 bp, Glycine max
ggagagctgtaccgtgtgatctgcgacaccaagggagctttcgtgcagccggctatatacgaggcttttggtttgacagtggttgaggccatgacttgtgggttgccaacattcgccacatgcaatggtggtcctgctgagatcattgtgcatggcaagtctggcttccacattgacccttaccatggtgaccgtgctgctgatctccttgttgacttctttgagaagtgcaagcttgacccaacccactgggaaacaatctcaaaggc

SEQ ID NO: 2375 - DNA, 258 bp, Glycine max
tggggtgacaacgcagagcgtgttcttgagtcaattcaacttctcttggatcttcttgaggcccctgacccttgcacccttgagactttccttggaagaattcctatggtcttcaatgttgtcattctttctccccatggttactttgcccaagataatgtcttgggataccctgacactggtggccaggttgtttacatcttggatcaagttcgtgctttggagaacgagatgctccatcgcattaagcaacaagga

SEQ ID NO: 2376 - DNA, 275 bp, Glycine max
ctggagctgatcaaaccatttacttcccccacactgaaaccacccgtacgttgacatccttccaccctgaaatcgaagcactcctttacagctcagtggagaatgaagaacacatatgtgtgctgaaggaccgcagcaagccaattatcttcaccatggcaaggttggatcgagtgaagaacatcacaggacttgtggagtggtacggtaagaacgcgaactgagggagctggtgaaccttgtggttgttgctggagacaggaggaaggagtcaa

SEQ ID NO: 2377 - DNA, 255 bp, Glycine max
tgaaatcgaagaactcctttacagctcagtggagaatgaagaacacatatgtgtgctgaaggaccgcagcaagccaattatcttcaccatggcaaggttggatcgagtgaagaacatcacaggacttgtggagtggtacggtaagaacgcgaactcgagggagctggtgaaccttgtggttgttgctggagacaggaggaaggagtcaaaggacttggaagaaaaggccgagatgaagaagatgtacggcctgat

SEQ ID NO: 2378 - DNA, 289 bp, Glycine max
gtcggagacaggaggaaggagtcgaaggacttggaagagaaggccgagatgaagaagatgtacggcctgatcgctccctacaagttgaacgggcaattcagatggatttcatctcagatgaaccgtgtgaggaacggagagctgtaccgtgtgatctgcgacaccaagggagctttcgtgcagccggctatatacgaggcttttggtttgacagtggttgaggccatgacttgtgggttgccaacattcgccacatgcaatggtggtcctgctgagatcattgtgcatg

SEQ ID NO: 2379 - DNA, 256 bp, Glycine max
cgcgtgatctgcgacaccaggggtgctttcgtgcagcctgctgtatacgaggcttttggtttgacagtggttgaggccatgacttgcggcttgccaacattcgccacatgcaatggtggtcctgctgagatcattgtgcacggcaagtctggcttccacattgacccttaccatggtgaccgtgctgctgatctccttgttgacttctttggaagtgcaagcttgacccaactcactgggacaagatctcaaaggc

SEQ ID NO: 2380 - DNA, 273 bp, Glycine max
cttgagaaggtgttcggaaccgagcactcccacattcttcgagttccctttagaactgagaagggaattgttcgtcagtggatctcaagattcgaagtctggccatacttggaaacttacactgaggatgttgctcatgagcttgccaaagagttgcaaggcaagccagatctgattgtcggaaactacagtgatggaaacattgttgcctctttgttggcacataaattaggagtcactcagtgtaccattgctcatgcacttgagaagacc

SEQ ID NO: 2381 - DNA, 254 bp, Glycine max
acatgagcttgccaaagagttgcaaggcaagccagatctgattgtcggaaactacagtgatggaaacattgttgcctctttgttggcacataaattaggagtcactcagtgtaccattgctcatgcacttgagaagaccaaataccccgaatccgacatttactggaaaaaattggaagagagataccacttctcttgccaattcacagctgatctatttgccatgaaccacacagatttcattatcaccagta

SEQ ID NO: 2382 - DNA, 245 bp, Glycine max
ttgacagtggttgaggccatgacttgcggcttgccaacattcgccacatgcaatggtggtcctgctgagatcattgtgcacggcaagtctggcttccacattgacccttaccatggtgaccgtgctgctgatctccttgttgacttctttgagaagtgcaagcttgacccaacccactgggacaagagctcaaaggctggtctccagcgtattgaagagaagtacacatggcaaatttactctca

SEQ ID NO: 2383 - DNA, 253 bp, Glycine max
gaatggagagctctaccgcgtgatctgcgacaccaggggtgctttcgtgcagcctgctgtatacgaggcttttggtttgacagtggttgacgccatgacttgcggcttgccaacattcgccacatgcaatggtggtcctgctgagatcattgtgcacggcaagtctggcttccacattgacccttaccatggtgaccgtgctgctgatctccttgttgacttctttgagaagtgcaagcttgacccaactcac

SEQ ID NO: 2384 - DNA, 274 bp, Glycine max
cagatctgattgttggaaactacagtgatggaaacattgtcgcttctttgttggcacataaattaggtgtcactcagtgtaccattgctcacgcacttgagaagaccaaataccccgaatccgacatttactggaaaaaattggaagagagataccacttctcttgccaattcacagctgatctatttgccatgaaccacacagatttcattatcaccagtaccttccagggattgctggaagcaaggacactgttggacagtacgaatctcac

SEQ ID NO: 2385 - DNA, 254 bp, Glycine max
tcgaagaactcctttacagctcagtggagaatgaagaacacatatgtgtgctgaaagaccgcagcaagccaattatcttcaccatggcaaggttggatcgagtgaagaacatcacaggacttgtggagtggtacggtaagaacgcgaactgagggagctggtgaaccttgtggttgttgctggagacaggaggaaggagtcaaaggacttggaagaaaaggccgagatgaagaagatgtacggcctgatcgaga

SEQ ID NO: 2386 - DNA, 249 bp, Glycine max
aaagactttgatgttgaatgacagaattcaaaacccagatgcactccaacatgttctgaggaaagctgaggagtatctgggcacagtgcctcctgaaactccctactcagaatttgagcacaagttccaggagattggtttggagagagggtggggtgacaacgcagagcgtgttcttgagtcaattcaacttctcttggatcttcttgaggcccctgacccttgcacccttgagactttccttggaag

SEQ ID NO: 2387 - DNA, 253 bp, Glycine max
caaaattcaacattgtctcccctggagctgatcaaaccatttacttcccccacactgaaaccagccgtaggttgacatccttccaccctgaaatcgaagaactcctttacagctcagtggagaatgaagaacacatatgtgtgctgaaggaccgcagcaagccaattatcttcaccatggcaaggttggatcgagtgaagaacatcacaggacttgtggagtggtacggtaagaacgcgaactgagggagctg

SEQ ID NO: 2388 - DNA, 242 bp, Glycine max
gggaattgttcgcaagtggatctcaagattcgaagtctggccctacttggaaacttacactgaggatgttgcccacgagcttgccaaagagttgcaaggcaagccagatctgattgttggaaactacagtgatggaaacattgtcgcttctttgttggcacataaattaggtgtcactcagtgtaccattgctcacgcacttgagaagaccaaataccccgaatccgacatttactggaaaa

SEQ ID NO: 2389 - DNA, 234 bp, Glycine max
gttgcaaggcaagccagatctgattgttggaaactacagtgatggaaacattgtcgcttctttgttggcacataaattaggtgtcactcagtgtaccattgctcacgcacttgagaagaccaaataccccgaatccgacatttactggaaaaaattggaagagagataccacttctcttgccaattcacagctgatctatttgccatgaaccacacagatttcattatcaccag

SEQ ID NO: 2390 - DNA, 239 bp, Glycine max
accgcgttgtgcatggtattgatgtctttgatccaaaattcaacattgtctcccctggagctgatcaaaccatttacttcccccacactgaaaccagccgtaggttgacatccttccaccctgaaatcgaagaactcctttacagctcagtggagaatgaagaacacatatgtgtgctgaaggaccgcagcaagccaattatcttcaccatggcaaggttggatcgagtgaagaacatc

SEQ ID NO: 2391 - DNA, 267 bp, Glycine max
attctccccgatgcaatcggaactacttgtggccaacgtcttgagaaggtgttcggaaccgagcactcccacattcttcgagttccctttagaactgagaagggaattgttcgtcagtggatctcaagattcgaagtctggccatacttggaaacttacactgaggatgttgctcatgagcttgccaaagagttgcaaggcaagccagatctgattgtcggaaactacagtgatggaaacattgatgcctctttgttggcacataaa

SEQ ID NO: 2392 - DNA, 270 bp, Glycine max
cgtagtagctcggaatcgctcgagctcgagcggatgtctttgatccaaaattcaacattgtctcccctggagctgatcaaaccatttacttcccccacactgaaaccagccgtaggttgacatccttccaccctgaaatcgaagaactcctttacagctcagtggagaatgaagaacacatatgtgtgctgaaggaccgcagcaagccaattatcttcaccatggcaaggttggaccgagtgaagaacatcacaggacttgtggagtggt

SEQ ID NO: 2393 - DNA, 284 bp, Glycine max
acaggaggaaggagtccaaggacttggaagagaaggccgagatgaagaagatgtatggcctcatcgagacctacaagttgaacggccaattcagatggatctcctctcagatgaaccgtgtgaggaacggagagctctaccgtgtcatctgtgacacaaggggtgcctttgtgcagcctgcagtttatgaggcctttgggttgactgtggttgaggccatgacttgtgggttaccaacatttgccacatgcaatggtggtcctgctgagatcattgtgcatgga

SEQ ID NO: 2394 - DNA, 247 bp, Glycine max
cgcgttgtgcatggtattgatgtctttgatccaaaattcaacattgtctcccctggagctgatcaaaccatttacttcccccacactgaaaccagccgtaggttgacatccttccaccctgaaatcgaagaactcctttacactcagtggagaatgaagaacacatatgtgtgctgaaggaccgcagcaagccaattatcttcaccatggcaaggttggatcgagtgaagaacatcacaggacttgt

SEQ ID NO: 2395 - DNA, 247 bp, Glycine max
  unsure (1)..(247): unsure at all n locations
agagataccacttctctcgccaattcacagctgatctatttgccatgaaccacacagatttcattatcancagtaccttccaggagattgctggaagcaaggacactgttggacagtacgaatctcacacagcctcacccttcctggactctaccgcgttgtgcatggtattgatgtctttgatccaaaattcaacattgtctcccctggagctgatcaaaccatttacttcccccacactgaaacc

SEQ ID NO: 2396 - DNA, 279 bp, Glycine max
ggttgacctccttccaccccgaaatcgaagaacttctttacagctctgtggagaatgaagaacacatatgcgtgctgaaggaccgcagcaagccgattatcttcaccatggcaaggttggaccgtgtgaagaacatcacagactcgtggagtggtacggtaagaacgcgaactgaagggagttggtgaaccttgtggttgttgccggagacaggaggaaggagtcgaaggacttggaagagaaggctgagatgaagaagatgtacggcctgatcgagac

SEQ ID NO: 2397 - DNA, 260 bp, Glycine max
cttgtggcgaacgtcttgagaaggtgttcggaactgagcactcccacattcttcgagttcgctttagaactgagaagggaattgttcgcaagtggatctcaagattcgaagtctggccctacttggaaacttacactgaggatgttgcccacgagcttgccaaagagttgcaaggcaagccagatctgattgttggaaactacagtgatggaaacattgtcgcttctttgttggcacataaattaggtgtcactcagtgt

SEQ ID NO: 2398 - DNA, 210 bp, Glycine max
gtcggaaactacagtgatggaaacattgttgcctctttgttggcacataaattaggagtcactcagtgtaccattgctcatgcacttgagaagaccaaataccccgaatccgacatttactggaaaaaattggaagagagataccacttctcttgccaattcacagctgatctatttgccatgaaccacacagatttcattatcaccagt

SEQ ID NO: 2399 - DNA, 243 bp, Glycine max
catgagcttgccaaagagttgcaaggcaagccagatctgattgtcggaaactacagtgatggaaacattgttgcctctttgttggcacataaattaggagtcactcagtgtaccattgctcatgcacttgagaagaccaaataccccgaatccgacatttactggaaaaaattggaagagagataccacttctcttgccaattcacagctgatctatttgccatgaaccacacagatttcatt

SEQ ID NO: 2400 - DNA, 257 bp, Glycine max
cgagatgctccatcgcattaagcaacaaggattggacattgtacctcgtattctcattatcacccgtcttctccccgatgcaatcggaactacttgtggccaacgtcttgagaaggtgttcggaaccgagcactcccacattcttcgagttccctttagaactgagaagggaattgttcgtcagtggatctcaagattcgaagtctggccatacttggaaacttacactgaggatgttgctcatgagcttgccaaag

SEQ ID NO: 2401 - DNA, 286 bp, Glycine max
atgtgtattgaaggaccgcaacaagccgatcatcttcaccatggcaagacttgaccgtgtgaagaacatcacgggacttgtggagtggtatggcaagaatgcgcgcctccgcgagttggtaaacctcgtggtggtggccggagacaggaggaaggagtccaaggacttggaagagaaggccgagatgaagaagatgtatggcctcatcgagacctacaagttgaacggccaattcagatggatctcctctcagatgaaccgtgtgaggaacggagagctctaccgt

SEQ ID NO: 2402 - DNA, 275 bp, Glycine max
  unsure (1)..(275): unsure at all n locations
cctccttccaccccgaaatcgaagncacttctttacagctctgtggagaatgaagaacacatatgcgtgctgaaggaccgcagcaagccgattatcttcaccatggcaaggttggaccgtgtgaagaacatcacaggactcgtggagtggtacggtaagaacgcgaactgagggagttggtgaaccttgtggttgttgccggagacaggaggaaggagtcgaaggacttggaagagaaggctgagatgaagaagatgtacggcctgatcgagacc

SEQ ID NO: 2403 - DNA, 249 bp, Glycine max
gtggttgttgccggagacaggaggaaggagtcgaaggacttggaagagaaggccgagatgaagaagatgtacggcctgatcgagacctacaagttgaacgggcaattcagatggatttcatctcagatgaaccgtgtgaggaacggagagctgtaccgtgtgatctgcgacaccaagggagctttcgtgcagccggctatatacgaggcttttggtttgacagtggttgaggccatgacttgtgggttg

SEQ ID NO: 2404 - DNA, 271 bp, Glycine max
gaaccgagcactcccacattcttcgagttccctttagaactgagaagggaattgttcgtcagtggatctccaagattcgaagtctggccatacttggaaacttacactgaggatgttgctcatgagcttgccaaagagttgcaaggcaagccagatctgattgtcggaaactacagtgatggaaacattgttgcctctttgttggcacataaattaggagtcactcagtgtaccattgctcatgcacttgagaagaccaaataccccgaat

SEQ ID NO: 2405 - DNA, 251 bp, Glycine max
gataatgtcttgggataccctgacactggtggccaggttgtttacatcttggatcaagttcgtgctttggagaacgagatgctccatcgcattaagcaacaaggattggacattgtacctcgtattctcattatcacccgtcttctccccgatgcaatcggtactacttgtggccaacgtcttgagaaggtgttcggaaccgagcactcccacattcttcgagttctctttagaactgagaagggaattgt

SEQ ID NO: 2406 - DNA, 247 bp, Glycine max
ggtggggtgacaacgcagagcgtgttcttgagtcaattcaacttctcttggatcttcttgaggcccctgacccttgcacccttgagactttccttggaagaattcctatggtcttcaatgttgtcattctttctccccatggttactttgcccaagataatgtcttgggataccctgacactggtggccaggttgtttacatcttggatcaagttcgtgctttggagaacgagatgctccatcgcat

SEQ ID NO: 2407 - DNA, 282 bp, Glycine max
tgagagggggtggggtgacactgccgagcgtgtcctcgagatgatccagcttctcctggaccttcttgaggcacctgacccttgcaccctcgagacattccttggaagagtccctatggtcttcaatgttgttatcctttctccccatggttactttgcccaagataatgtcttgggataccctgacactggtggacaggttgtttacatcttggatcaagttcgtgccttggagaatgagatgctcaaccgcatcaagaaacaaggccttgatatcacccc

SEQ ID NO: 2408 - DNA, 309 bp, Glycine max
  unsure (1)..(309): unsure at all n locations
catcactgtagtntccaacantcagatctggaaacattgttgcctctttgttagcacataaattaggngtaactcagtgtaccattgctcatgctctagaaaagaccaagtaccctgagtctgacatttactggaaanantttgaagaganatatcatttctcatgccaatttactgctgatctttttgcaatgaaccacacagactttatcatcaccagcnccttccaagagattgctggaagcaaggacactgtnggacagtatgagagtcacactgccttcacccttccangactttaccgtgttg

SEQ ID NO: 2409 - DNA, 251 bp, Glycine max
ctggactctaccgtgttgtgcacggcattgatgtctttgatccaaaattcaacattgtctcccctggagctgatcaaaccatttacttcccccccaccgaaactagccgtaggttgacctccttccaccccgaaatcgaagaacttctttacagctctgtggagaatgaagaacacatatgcgtgctgaaggaccgcagcaagccgattatcttcaccatggcaaggttggaccgtgtgaagaacatcaca

SEQ ID NO: 2410 - DNA, 248 bp, Glycine max
cacagatttcattatcaccagtaccttccaggagattgctggaagcaaggacactgttggacagtatgagtctcacacagcctttacccttcctggactctaccgtgttgtgcacggcattgatgtctttgatccaaaattcaacattgtctcccctggagctgatcaaaccatttacttcccccccaccgaaactagccgtaggttgacctccttccaccccgaaatcgaagaacttctttacagct

SEQ ID NO: 2411 - DNA, 250 bp, Glycine max
tggagacaggaggaaggagtcaaaggacttggaagaaaaggccgagatgaagaagatgtacggcctgatcgagacctacaagttgaacggccaattcagatggatttcatcgcagatgaaccgtgtgaggatggagagctctaccgcgtgatctgcgacaccaggggtgctttcgtgcagcctgctgtatacgaggcttttggtttgacagtggttgaggccatgacttgcggcttgccaacattcgcca

SEQ ID NO: 2412 - DNA, 253 bp, Glycine max
caaaacccagatgcactccaacatgttctgaggaaagctgaggagtatctgggcacagtgcctcctgaaactccctactcagaatttgaggacaagttccaggagattggtttggcgagagggcggggtgacaagcagagcgtgttcttgagtcaattcaacttctcttggatcttcttgaggcccctgacccttgcacccttgagactttccttggaagaattcctatggtcttcaatgttgtcattctttc

SEQ ID NO: 2413 - DNA, 237 bp, Glycine max
cagatctgattgttggaaactacagtgatggaaacattgtcgcttctttgttggcacataaattaggtgtcactcagtgtaccattgctcacgcacttgagaagaccaaataccccgaatccgacatttactggaaaatattggaagagagataccacttctcttgccaattccccgctgatctatttgccatgaaccacacagatttcattatcaccagtaccttccaggagattg

SEQ ID NO: 2414 - DNA, 264 bp, Glycine max
tagcaatgacactgttggacagtatgagtctgacacagcctttacccttcctggactctaccgtgttgtgcacggcattgatgtctttgatccaaaattcaacattgtctccccggagctgatcaaaccatttacttcccccccaccgaaactagccgtaggttgacctccttccaccccgaaatcgaagaacttctttacagctctgtggagaatgaagaacacatatgcgtgctgaaggaccgcagcaagccgattatcttc

SEQ ID NO: 2415 - DNA, 246 bp, Glycine max
gaagaacacatatgcgtgctgaaggaccgcagcaagccgattatcttcaccatggcaaggttggaccgtgtgaagaacatcacaggactcgtggagtggtacggtaagaacgcgaactgagggagttggtgaaccttgtggttgttgccggagacaggaggaaggagtcgaaggacttggaagagaaggccgagatgaagaagatgtacggcctgatcgagacctacaagttgaacgggcaattca

SEQ ID NO: 2416 - DNA, 247 bp, Glycine max
ttcacagctgatctatttgccatgaaccacacagatttcattattaccagtaccttccaggagattgctggaagcaaggacactgttggacagtatgagtctcacacagcctttacccttcctggactctaccgtgttgtgcacggcattgatgtctttgatccaaaattcaacattgtctcccctggagctgatcaaaccatttacttcccccccaccgaaactagccgtaggttgacctccttcc

SEQ ID NO: 2417 - DNA, 257 bp, Glycine max
  unsure (1)..(257): unsure at all n locations
gccatgaaccacacagatttcattatcaccagtaccttccaggagattgctggaagcanggacactgttggacagtatgagtctcacacagcctttacccttcctggactctaccgtgttgtgcacggcattgatgtctttgatccaaaattcaacattgtctcccctggagctgatcaaaccatttacttcccccccaccgaaactagccgtagttgacctccttccaccccgaaatcgaagaacttctttacagc

SEQ ID NO: 2418 - DNA, 247 bp, Glycine max
cggcactgatgtctttgatccaaaattcaacattgtatcccctggagctgatcaaaccatttacttcccccccaccgaaactagccgtaggttgacctccttccaccccgaaatcgaacaacttctttacagctctgtggagaatgaagaacacatatgcgtgctgaaggaccgcagcaagccgattatcttcaccatggcaaggttggaccgtgtgaacgacatcacaggactcgtggagtggtac

SEQ ID NO: 2419 - DNA, 267 bp, Glycine max
gccaattcagatggatatcctctcagatgaaccgtgtgaggaacggagagctctaccgtgtcatctgtgacacaaggggtgcctttgtgcagcctgcagtttatgaggcctttgggttgactgtggttgaggccatgacttgtgggttgccaacgtttgccacatgcaatggtggtcctgctgagatcattgtgcatggaaaatctggttaccacattgatccttaccatggtgaccatgctgctgagatccttgttgagttctttg

SEQ ID NO: 2420 - DNA, 229 bp, Glycine max
gtgacaacgcagagcgtgttcttgagtcaattcaacttctcttggatcttcttgaggcccctgacccttgcacccttgagactttccttggaagaattcctatggtcttcaatgttgtcattctttctccccatggttactttgcccaagataatgtcttgggataccctgacactggtggccaggttgtttacatcttggatcaagttcgtgctttggagaacgagat

SEQ ID NO: 2421 - DNA, 265 bp, Glycine max
gtcaaaggacttggaagaaaaggccgagatgaagaagatgtacggcctgatcgagacctacaagttgaacggccaattcagatggatttcatcgcagatgaaccgtgtgaggaatggagagctctaccgcgtgatctgcgacaccaggggtgctttcgtgcagcctgctgtatacgaggcttttggtttgacagtggttgaggccatgacttgcggcttgccaagattcgccacatgcaatgtgggtcctgctgagatcattgtg

SEQ ID NO: 2422 - DNA, 250 bp, Glycine max
ggaagagagataccacttctcttgccaattcacagctgatctatttgccatgaaccacacagatttcattatcaccagtaccttccaggagattgctggaagcaaggacactgttggacagtacgaatctcacacagccttcacccttcctggactctaccgcgttgtgcatggtattgatgtctttgatccaaaattcaacattggctcccctggagctgatcataccatttacttcccccacactgaa

SEQ ID NO: 2423 - DNA, 237 bp, Glycine max
ataccacttctcttgccaattcacagctgatctatttgccatgaaccacacagatttcattatcaccagtaccttccaggagattgctggaagcaaggacactgttggacagtatgagtctcacacagcctttacccttcctggactctaccgtgttgtgcacggcattgatgtctttgatccaaaattcaacattgtctcccctggagctgatcaaaccatttacttcccccccac

SEQ ID NO: 2424 - DNA, 282 bp, Glycine max
gcgtgctgaaggaccgcagcaagccgattatcttcaccatggcaaggttggaccgtgtgaagaacatcacaggactcgtggagtggcacggtaagaacgcgaactgagggagttggtgaaccttgtggttgttgccggagacaggaggaaggagtcgaaggacttggaagagaaggccgagatgaagaagatgtacggcctgatcgagacctacaagttgaacgggcaattcagatggatttcatctcagatgaaccgtgtgaggaacggagagctgtaccg

SEQ ID NO: 2425 - DNA, 313 bp, Glycine max
gtacgtaagttcggtctacggctcgttcagcatcgacatcctctcacatgaactgtgtgacgaacggagagctctaccgtgtcatctgtgacacaaggggtgcctttgtgcagcctgcagtttatgaggcctttgggtacactgtggttgaggccatgacttgtgggttgccaacgtttgccacatgcaatggtggtcctgctgagatcattgtgcatggaaaatctggttaccacattgatccttaccatggtgaccatgctgctgagatccttgttgagttctttgagaagagcaaggctgatccatctca

SEQ ID NO: 2426 - DNA, 271 bp, Glycine max
gagaatgaggaacacatatgcgtattgaaggaccgcaacaaaccaataatcttcaccatggcaaggcttgaccgtgtgaagaacatcacggggcttgtcgagtggtacgggaagaacgcacgcctccgcgagttggtgaacctggtggtggtggctggagacaggaggaaggagtcgaaggacttggaagagaaggccgagatgaagaagatgtatggcctcatcgagacctacaagttgaacggccaattcagatggatatcctctcaga

SEQ ID NO: 2427 - DNA, 258 bp, Glycine max
aaaccatttacttcccccccaccgaaactagccgtaggttgacctccttccaccccgaaatcgaagaacttctttacagctctgtggagaatgaagaacacatatgcgtgctgaaggaccgcagcaagccgcttatcttcaccatggcaaggttggaccgtgtgaagaacatcacaggactcgtggagtggtacggtaagaacgcgaactcgagggagttggtgaaccttgtggttgttgccggagacaggaggaagg

SEQ ID NO: 2428 - DNA, 263 bp, Glycine max
tacaagttgaacggccaattcagatggatatcctctcagatgaaccgtgtgaggaacggagagctctaccgtgtcatcttcgacacaaggggtgcctttgtgcagcctgcagtttatgaggcctttgggttgactgtggttgacgccatgacttgtgggttgccaacgtttgccacatgcaatggtggtcctgctgagatcattgtgcatggaaaatctggttaccacattgatccttaccatggtgaccatgctgctgagat

SEQ ID NO: 2429 - DNA, 252 bp, Glycine max
ggaagtaaatggtttgatcagctccaggggagacatccttccaccctgaaatcgaagaactcctttacagctcagtggagaatgaagaacacatatgtgtgctgaaggaccgcagcaagccaattatcttcaccatggcaaggttggatcgagtgaagaacatcacaggacttgtggagtggtacggtaagaacgcgaactcgagggagctggtgaaccttgtggttgttgctggagacaggaggaaggagt

SEQ ID NO: 2430 - DNA, 234 bp, Glycine max
gggaaagactttgatgttgaatgacagccttcaaaacccagatgcactccaacatgttctgaggcaagctgaggagtatctgggcacagtgcctcctgaaactccctactcagaatttgagcacaagttccaggagattggtttggagagagggtgcggtgacaacgcagagcgtgttcttgagtcaattcaacttctcttggatcttcttgaggcccctgacccttgcaccct

SEQ ID NO: 2431 - DNA, 266 bp, Glycine max
gtgacattctcagagttcctttcagaacagaaaagggaattgttcgcaaatggatctcaagattcgaagtctggccatacctagagacttacactgaggatgtcgcccttgaacttgccaaggagttgcaagccaagccagatctgattgttggaaactacagtgatggaaacattgttgcctctttgttagcacataaattaggagtaactcagtgtaccattgctcatgctctagaaaagaccaagtaccctgagtctgacatt

SEQ ID NO: 2432 - DNA, 276 bp, Glycine max
  unsure (1)..(276): unsure at all n locations
gcctgagtctgacatttactggaaaaaatttgaagagaaatatcatttctcatgccaatttactgctgatctttttgcaatgaaccacacagactttatcatcaccagcaccttccaagagattgctggaagcaaggacactgntggacagtatgagagtcacactgccttcacccttccaggactttaccgtgttgttcacggtattgatccatttgatccaaagttcaacattgtctctcccggtgcagacatgggtatatacttcccatacac

SEQ ID NO: 2433 - DNA, 268 bp, Glycine max
tcgagacctacaagttgaacggccaattcagatggatatcctctcagatgaaccgtgtgaggaacggagagctctaccgtgtcatctgtgacacaaggggtgcctttgtgcagcctgcagtttatgaggcctttgggttgactgtggttgaggccatgacgtgtgggttgccaacgtttgccacatgcaatggtggtcctgctgagatcattgtgcatggaaaatctggttaccacattgatccttaccatggtgaccatgctgctga

SEQ ID NO: 2434 - DNA, 279 bp, Glycine max
gcgtattgaaggaccgcaacaaaccaataatcttcaccatggcaaggcttgaccgtgtgaagaacatcacggggcttgtcgagtggtcgggaagaacgcacgcctccgcgagttggtgaacctggtggtggtggctggagacaggaggaaggcgtcgaaggacttggaagagaaggccgagatgaagaagatgtatggcctcatcgagacctacaagttgaacggccaattcagatggatatcctctcagatgaaccgtgtgaggaacggagagctcta

SEQ ID NO: 2435 - DNA, 222 bp, Glycine max
cgttgtttacatcttggatcacgttcgtgctttggagattgagatgctccatcgcattaagcaacaaggattggacattgttcctcgtattctcattatcacccgtcttctccccgatgcagtaggaactacttgtggccaacgtcttgagaaggtgttcggaactgagcactcccacattcttcgagttccctttagaactgagaagggaattgttcgcaa

SEQ ID NO: 2436 - DNA, 259 bp, Glycine max
atggatctcaagattcgaagtctggccatacctagagacttacactgaggatgtcgccctggaacttgccaaggagttgcaagccaagccagatctgattgttggaaactacagtgatggaaacattgttgcctctttgttagcacataaattaggagtaactcagtgtaccattgctcatgctctagaaaagaccaagtaccctgagtctgacatttactggaaaaaatttgaagagaaatatcatttctcatgccaa

SEQ ID NO: 2437 - DNA, 251 bp, Glycine max
gtccaaggacttggaagagaaggccgagatgaagaagatgtatggcctcatcgagacctacaagttgaacggccaattcagatggatctcctctcagatgaaccgtgtgaggaacggagagctctaccgtgtcatctgtgacacaaggggtgcctttgtgcagcctgcagtttatgaggcctttgggttgactgtggttgaggccatgacttgtgggttaccaacatttgccacatgcaatggtggtcctg

SEQ ID NO: 2438 - DNA, 253 bp, Glycine max
ggagagctgtaccgtgtgatctgcgacaccaatggagctttcgtgcagccggctatatacgaggcttttggcttgacactggttgaagccatgacttgtaggttgccaacattcgccacatgcaatggtggtcctgctgagatcattgtgcatggcaagtctggcttccacattgacccttaccatggtgaccgtgctgcggatctccctgctgacttctttgagaagtgcaagcttgacccaacccactggg

SEQ ID NO: 2439 - DNA, 229 bp, Glycine max
cccatggttactttgcccaagataatgtcttgggataccctgacactggtggccaggttgtttacatcttggatcaagttcgtgctttggagaacgagatgctccatcgcattaagcaacaaggattggacattgtacctcgtattctcattatcacccgtcttctccccgatgcaatcggaactacttgtggccaacgtcttgagaaggtgttcggaaccgagcactc

SEQ ID NO: 2440 - DNA, 260 bp, Glycine max
gccgagatgaagaagatgtatggcctcatcgagacctacaagttgaacggccaattcagatggatatcctctcagatgaaccgtgtgaggaacggagagctctaccgtgtcatctgtgacacaaggggtgcctttgtgcagcctgcagtttatgaggcctttgggttgactgtggttgaggccatgacttgtgggttgccaacgtttgccacatgcaatggtggtcctgctgagatcattgtgcatggaaaatctggtta

SEQ ID NO: 2441 - DNA, 250 bp, Glycine max
  unsure (1)..(250): unsure at all n locations
tggaaacattgttgcctctttgttggcacataaattaggagtcactcagtgtaccattgctcatgcacttgagaagaccaaataccccgaatccgacatttactggaaaaaattggaagagagataccacttctcttgccaattcacagctgatctatttgccatgaaccacacagatttcatcacaancagtaccttccaggagattgctggactgcaggacactgttggacagtatgagtctcacaca

SEQ ID NO: 2442 - DNA, 259 bp, Glycine max
gcttctttacagctcagtggagaatgaggaacacatatgcgtattgaaggaccgcaacaaaccaataatcttcaccatggcaaggcttgaccgtgtgaagaacatcacggggcttgtcgagtggtacgggaagaacgcacgcctccgcgagttggtgaacctggtggtggtggctggagacaggaggaaggagtcgaaggacttggaagagaaggccgagatgaagaagatgtatggcctcatcgagacctacaagttg

SEQ ID NO: 2443 - DNA, 244 bp, Glycine max
aaggacttggaagagaaggccgagatgaagaagatgtatggcctcatcgagacctacaagttgaacggccaattcagatggatctcctctcagatgaaccgtgtgaggaacggagagctctaccgtgtcatctgtgacacaaggggtgcctttgtgcagcctgcagtttatgaggcctttgggttgactgtggttgaggccatgacttgtgggttaccaacatttgccacatgcaatggtggtc

SEQ ID NO: 2444 - DNA, 220 bp, Glycine max
cccccacactgaaaccagccgtaggttgacatccttccaccctgaaatcgaagaactcctttacagctcagtggagaatgaagaacacatatgtgtgctgaaggaccgcagcaagccaattatcttcaccatggcaaggttggatcgagtgaagaacatcacaggacttgtggagtggtacggtaagaccgcgaactggagggacctggaaaaccttggg

SEQ ID NO: 2445 - DNA, 248 bp, Glycine max
caagtaccctgagtctgacatttactggaaaaaatttgaagagaaatatcatttctcatgccaatttactgctgatctttttgcaatgaaccacacagactttatcatcaccagcaccttccaagagattgctggaagcaaggacactgttggacagtatgagagtcacactgccttcacccttccaggactttaccgtgttgttcacggtattgatccatttgatccaaagttcaacattgtctctc

SEQ ID NO: 2446 - DNA, 262 bp, Glycine max
cacggggcttgtcgagtggtacgggaagaacgcacgcctccgcgagttggtgaacctggtggtggtggctggagacaggaggaaggagtcgaaggacttggaagagaaggccgagatgaagaagatgtatggcctcatcgagacctacaagttgaacggccaattcagatggatatcctctcagatgaaccgtgtgaggaacggagagctctaccgtgtcatctgtgacacaaggggtgctcctgtgcagcctgcagtttat

SEQ ID NO: 2447 - DNA, 273 bp, Glycine max
gaacttgccaaggagttgcaagccaagccagatctgattgttggaaactacaatgatggaaacattgttgcctctttgttagcacataaattaggagtaactcagtgtaccattgctcatgctctagaaaagaccaagtaccctgagtctgacatttactggaaaaaatttgaagagaaatatcatttctcatgccaatttactgctgatctttttgcaatgaaccacacagactttatcatcaccaggaccttccaagagattgctggaagc

SEQ ID NO: 2448 - DNA, 290 bp, Glycine max
  unsure (1)..(290): unsure at all n locations
taancagattgatccttaccatggtgancatgctgctgagatccttgttgagntctttgagaagancaaggctgntncntctcactgggacnnaatctcccagggnggactcaagcgtattcatgnnaagtacacatggcaaatttactcggncaggctcttgacactcactggtgtgtatggcttctggaagcacgtgaccaatcttgaacgccgtgagagcaaacgttacctcgagatgttctatgctctcaagtaccgcaaattggctgagtctgtgccccttgcta

SEQ ID NO: 2449 - DNA, 257 bp, Glycine max
gaagaacgcacgcctccgcgagttggtgaacctggtggtggtggctggagacaggaggaaggagtcgaaggacttggaagagaaggccgagatgaagaagatgtatggcctcatcgagacctacaagttgaacggccaattcagatggatatcctctcagatgaaccgtgtgaggaacggagagctctaccgtgtcatctgtgacacaaggggtgcctttgtgcagcctgcagtttatgaggcctttgggttgactg

SEQ ID NO: 2450 - DNA, 304 bp, Glycine max
  unsure (1)..(304): unsure at all n locations
aggtgaccatgctgctgagatccttgttgagttctttgagaagagcaaggctgatccatctcactgggacaaaatctcccagggtggactcaagcgtattcatgagaagtacacatggcaaatttactcggacaggctcttgacactcactggtgtgtatggctncganaagcacgtgaccaatcttgaacgccgtgagagcaaacgttacctcgagatgttctatgctctcaagtaccgcaaattggctgagtctgtgccccttgctattgaagagtaaattcatgtttgaagagaacatcaa

SEQ ID NO: 2451 - DNA, 248 bp, Glycine max
agaaggccgagatgaagaagatgtatggcctcatcgagacctacaagttgaacggccaattcagatggatatcctctcagatgaaccgtgtgagaaacggagagctctaccgtgtcatctgtgacacaaggggtgcctttgtgcagcctgcagtttatgaggcctttgggttgactgtgagataggccatgacttgtgggttgccaacgtttgccacatgcaatggtggtcctgctgagatcattgtg

SEQ ID NO: 2452 - DNA, 255 bp, Glycine max
agaacatcacggggcttgtcgagtggtacgggaagaacgcacgcctccgcgagttggtgaacctggtggtggtggctggagacaggaggaaggagtcgaaggacttggaagagaaggccgagatgaagaagatgtatggcctcatcgagacctacaagttgaacggccaattcagatggatatcctctcagatgaaccgtgtgaggaacggagagctctaccgtgtcatctgtgacacaaggggtgcctttgtgc

SEQ ID NO: 2453 - DNA, 259 bp, Glycine max
gaagaacatcacggggcttgtcgagtggtacgggaagaacgcacgcctccgcgagttggtgaacctggtggtggtggctggagacaggaggaaggagtcgaaggacttggaagagaaggccgagatgaagaagatgtatggcctcatcgagacctacaagttgaacggccaattcagatggatatcctctcagatgaaccgtgtgaggaacggagagctctaccgtgtcatctgtgacacaaggggtgcctttgtgcag

SEQ ID NO: 2454 - DNA, 276 bp, Glycine max
gctcgcagctggcctcatcgagacctacaagttgaacggccaattcagatggatatcctctcagatgaaccgtgtgaggaacggagagctctaccgtgtcatctgtgacacaaggggtgcctttgtgcagcctgcagtttatgaggcctttgggttgactgtggttgaggccatgacttgtacggttgccaacgtttgccacatgcaatggtggtcctgctgacatcactgtgcatggaaaatctggttaccacattgatccttaccatggtgacc

SEQ ID NO: 2455 - DNA, 231 bp, Glycine max
cacagcgtcaagggaaagactttgatgttgaatgacagaattcaaaacccagatgcactccaacatgttctgaggcaagctgaggagtatctgggcacagtgcctcctgaaactccctactcagaatttgagcacaagttccaggagattggtttggcgagagggtgcggtgacaacgcagagctagttcttgagtccattcaacttctctaggatctacttgaggcgcct

SEQ ID NO: 2456 - DNA, 245 bp, Glycine max
gaaaagaccaagtaccctgagtctgacatttactggaaaaaatttgaagagaaatatcatttctcatgccaatttactgctgatctttttgcaatgaaccacacagactttatcatcaccagcaccttccaagagattgctggaagcaaggacactgttggacagtatgagagtcacactgccttcacccttccaggactttaccgtgttgttcacggtattgatccatttgatcaaagttcaac

SEQ ID NO: 2457 - DNA, 236 bp, Glycine max
cagaccaagtaccctgagtctgacatttactggaaaaaatttgaagagaaatatcatttctcatgccaatttactgctgatctttttgcaatgaaccacacagactttatcatcaccagcaccttccaagagattgctggaagcaaggacactgttggacagtatgagagtcacactgccttcacccttccaggactttaccgtgttgttcacggtattgatccatttgatccaaa

SEQ ID NO: 2458 - DNA, 236 bp, Glycine max
gggaattgttcgcaaatggatctcaagattcgaagtctggccatacctagagacttacactgaggatgtcgcccttgaacttgccaaggagttgcaagccaagccagatctgattgttggaaactacagtgatggaaacattgttgcctctttgttagcacataaattaggagtaactcagtgtaccattgctcatgctctagaaaagaccaagtaccctgagtctgacatttact

SEQ ID NO: 2459 - DNA, 254 bp, Glycine max
cccacactgaaaccagccgtaggttgacatccttccaccctgaaatcgaagaactcctttacagctcagtggagaatgaagaacacatatgtgtgctgaaggaccgcagcaagccaattatcttcaccatggcaaggttggatcgagtgaagaacatcacaggacttgtggagtggtacggtaagaacgcgaactcgagggctggtgaaccttgtggttgttgctggagacaggaggaaggagtcaaaggactt

SEQ ID NO: 2460 - DNA, 261 bp, Glycine max
  unsure (1)..(261): unsure at all n locations
ccancaattcccttctcagttctaaagggaattgttcgtcannnngatctcangattcgaagtctggccatacttggaaacttacactgaggaacttgctcatgagcttgccaaagagttgcaaggcaagccagatctgattgtcggaaactacagtgatggaaacattgttgcctctttgttggcacataaattaggagtcatcagtgtaccattgctcatgcacttgagaagaccaaataccccgaatccgacatttat

SEQ ID NO: 2461 - DNA, 277 bp, Glycine max
catcaagaaacaaggccttgatatcacccctcgtattctcattatcactcgtcttctccctgatggcagtaggaactacctgtggccaacgtctagagagggtatatgatactgaatattgtgacattctcagagttcctttcagaacagaaaagggaattgttcgcaaatggatctcaagattcgaagtctggccatacctagagacttacactgaggatgtcgcccttgaacttgccaaggagttgcaagccaagccagatctgattgttggaaa

SEQ ID NO: 2462 - DNA, 247 bp, Glycine max
ggctcgagcggctcgagcgaaactagccagaggttgacctccttacaccccgaaatcgaagaacttgtttacagctctgtggagaatgaagaacacatatgcgtgctgaaggaccgcagcaagccgattatcttcaccatggcaaggttggaccgtgtgaagaacatcacaggactcgtggagtggtacggtaagaacgcgaagctgagggagttggtgaaccttgtggttgttgccggagacagga

SEQ ID NO: 2463 - DNA, 250 bp, Glycine max
cggctcgaggtttatgaggcctttgggttgactgtggttgaggccatgacttgtgggttgccaacgtttgccacatgcaatggtggtcctgctgagatcattgtgcatggaaaatctggttaccacattgatccttaccatggtgaccatgctgctgagatccttgttgagttctttgagaagagcaaggctgatccatctcactgggacaaaatctcccagggtggactcaagcgtattcatgagaagt

SEQ ID NO: 2464 - DNA, 268 bp, Glycine max
cagactttatcatcaccagcaccttccaagagattgctggaagcaaggacactgttggacagtatgagagtcacactgccttcacccttccaggactttaccgtgttgttcacggtattgatccatttgatccaaagttcaacattgtctctcccggtgcagacatgggtatatacttcccatacactgaaactgagcgtaggttaacagaattccactctgacattgaatcgcttctttacagctcagtggagaatgaggaacacat

SEQ ID NO: 2465 - DNA, 283 bp, Glycine max
ttgccacatgcaatggtggtcctgctgagatcattgtgcatggaaaatctggttaccacattgatccttaccatggtgaccatgctgctgagatccttgttgagttctttgagaagagcaaggctgatccatctcactgggacaaaatctcccagggtggactcaagcgtattcatgagaagtacacatggcaaatttactcggacaggctcttgacactcactggtgtgtatggcttctggaagcacgtgaccaatcttgaacgccgtgagagcaaacgtta

SEQ ID NO: 2466 - DNA, 269 bp, Glycine max
gtttacatcttggatcaagttcgtgccttggagaatgagatgctcaaccgcatcaagaaacaaggccttgatatcacccctcgtattctcattatcactcgtcttctccagcatgcagtaggaactacctgtggccaacgtctagagagggtatatgatactgaatattgtgacattctcagagttcctttcataacagaaaagggaattgttcgcaaatggatctcaagattcgaagtctggccatacctagagacttacactgagga

SEQ ID NO: 2467 - DNA, 253 bp, Glycine max
caagaatgcgcgcctccgcgagttggtaaacctcgtggtggtggccggagacaggaggaaggagtccaaggacttggaagagaaggccgagatgaagaagatgtatggcctcatcgagacctacaagttgacggccaattcagatggatctcctctcagatgaaccgtgtgaggaacggagagctctaccgtgtcatctgtgacacaaggggtgcctttgtgcagcctgcagtttatgaggcctttgggttga

SEQ ID NO: 2468 - DNA, 251 bp, Glycine max
tatcacttctcatgccaatttactgctgatctttttgcaatgaaccacacagactttatcatcaccagcaccttccaagagattgctggaagcaaggacactgttggacagtatgagagtcacactgccttcacccttccaggactctaccgtgttgttcacggtattgatccctttgatccagagttcaacatcgtctctcccggtgccgacatgagcatatacttcccatacactgaaactgagcgtag

SEQ ID NO: 2469 - DNA, 258 bp, Glycine max
cggctcgagacggctgcgagaagcgacagaagggcgacattgaagagcttctttacagctcagtggagaatgaagaacacatatgtgtattgaaggaccgcaacaagccgatcatcttcaccatggcaagacttgaccgtgtgaagaacatcacgggacttgtggagtggtatggcaagaatgcgcgcctccgcgagttggtaaacctcgtggtggtggccggagacaggaggaaggagtccaagggacttggaagag

SEQ ID NO: 2470 - DNA, 273 bp, Glycine max
  unsure (1)..(273): unsure at all n locations
attgatccctttgatccaaagttcaacatcgtctctcccggtgccgacatgagcatatacttcccatacactgaaactgagcgtaggttaacagagttccaccccgacattgaagcgnctctttacagctcagtggagaatgaagaacacatatgtgtattgaaggaccgcaacaagccgatcatcttcaccatggcaagacttgaccgtgtgaagaacatcacgggacttgtggagtggtatggcaagaatgcgcgcctccgcgagttggta

SEQ ID NO: 2471 - DNA, 257 bp, Glycine max
atgacttgtgggttaccaacatttgccacatgcaatggtggtcctgctgagatcattgtgcatggaaaatctggttaccacattgacccttaccatggtgaccgtgctgctgagatccttgttgagttctttgaaaagagcaaggctgacccatctcactgggacaaaatctcccagggtgtactcaagcgtattcatgagaagtacacatggcaaatttactctgacaggctcttgacactcactggtgtgtatgg

SEQ ID NO: 2472 - DNA, 239 bp, Glycine max
tggcaagaatgcgcgcctccgcgagttggtaaacctcgtggtggtggccggagacaggaggaaggagtccaaggacttggaagagaaggccgagatgaagaagatgtatggcctcatcgagacctacaagttgaacggccaattcagatggatctcctctcagatgaaccgtgtgaggaacggagagctctaccgtgtcatctgtgacacaaggggtgcctttgtgcagcctgcagttt

SEQ ID NO: 2473 - DNA, 263 bp, Glycine max
tgccaatttactgctgatctttttgcaatgaaccacacagactttatcatcaccagcaccttccaagatattgctggaagcaaggacactgttggacagtatgagagtcacactgccttcacccttccaggactctaccgtgttgttcacggtattgatccctttgatccaaagttcaacatcgtttctcgcggtgccgacatgagcatatacttcccatacactgaaactgttcgtaggttaacagagttccacacaacata

SEQ ID NO: 2474 - DNA, 230 bp, Glycine max
ccgctcgagcggctcgagcagtaccttccaggagattgctggaagcaaggacactgttggacagtatgagtctcacacagcctttacccctcctggactctaccgtgttgtgcacggcattgatgtctttgatccaaaattcaacattgtctcccctggagctgatcaaaccatttacttcccccccaccgaaactagccgtaggttgacctccttccaccccgaaatcg

SEQ ID NO: 2475 - DNA, 255 bp, Glycine max
aatttactgctgatctttttgcaatgaaccacacagactttatcatcaccagcaccttccaagagattgctggactcaaggacactgttggacagtatgagagtcacactgccttcacccttccaggactttaccgtgttgttcacggtattgatccatttgatccaaagttcaacattgtctctcccggtgcagacatgggtatatacttcccatacactgaaactgagcgtaggttaacagaattccactctg

SEQ ID NO: 2476 - DNA, 276 bp, Glycine max
  unsure (1)..(276): unsure at all n locations
ggagtatctgggcacagngcctcctgaaactcnctactgcagantttgagcacaagttccaggagnntggtttggagaganngtggggtgacaacgcgnantgtccttgagtcaattcaacttctcttggatcttcttgnggcccctgacccgtgcacccttgagactttccttggaagaatccctatggngttcaatgttgnnatctttctccccatggttactttgcccaagataatgtcttggganacctgacactggtggccaggttgttac

SEQ ID NO: 2477 - DNA, 251 bp, Glycine max
gtgacactgccgagcgtgtcctcgagatgatccagcttctcctggaccttcttgaggcacctgacccttgcaccctcgagacattccttggaagagtccctatggtcttcaatgttgttatcctttctccccatggttactttgcccaagataatgtcttgggataccctgacactggtggacaggttgtttacatcttggatcaagttcgtgccttggagaatgagatgctcaaccgcatcaagaaacaa

SEQ ID NO: 2478 - DNA, 270 bp, Glycine max
cggtgcagacatgggtatatacttcccatacactgaaactgagcgtaggttaacagaattccactctgacattgaagagcttctttacagctcagtggagaatgaggaacacatatgcgtattgaaggaccgcaacaaaccaataatcttcaccatggcaaggcttgaccgtgtgaagaacatcacggggattgtcgagtggtacgggaagaacgcacgcctccgcgagttggtgaacctggtggtggtggctggagacaggaggaagga

SEQ ID NO: 2479 - DNA, 174 bp, Glycine max
gatcaaaccatttacttcccccacactgaaaccagccgtaggttgacatccttccaccctgaaatcgaagaactcctttacagctcagtggagaatgaagaacacatatgtgtgctgaaggaccgcagcaagccaattatcttcaccatggcaaggttggatcgagtgaagaac

SEQ ID NO: 2480 - DNA, 239 bp, Glycine max
ccatgctgctgagatccttgttgagttctttgagaagagcaaggctgatccatctcactgggacaaaatctcccagggtggactcaagcgtattcatgagaagtacacatggcaaatttactcggacaggctcttgacactcactggtgtgtatggcttctggaaacacgtgaccaatcttgaacgccgtgagagcaaacgttacctcgagatgttctatgctctcaagtaccgcaaat

SEQ ID NO: 2481 - DNA, 237 bp, Glycine max
gaaccacacagactttatcatcaccagcaccttccaagagattgctggaagcaaggacactgttggacagtatgagagtcacactgccttcacccttccaggactctaccgtgttgttcacggtattgatccctttgatccaaagttcaacatcgtctctcccggtgccgacatgagcatatacttcccatacactgaaactgagcgtaggttaacagagttccaccccgacattga

SEQ ID NO: 2482 - DNA, 255 bp, Glycine max
ggttaacagagttccaccccgacattgaagggcttctttacagctcagtggagaatgacgaacacatatgtgtattgaaggaccgcaacaagccgatcatcttcaccatggcaagacttgaccgtgtgaagaacatcacggcacttgtggagtggtatggcaagaatgcgcgcctccgcgagttggtaaacctcgtcgtggtggccggagacaggaggcaggagtccacggacgtggaagagaaggccgagatga

SEQ ID NO: 2483 - DNA, 264 bp, Glycine max
gttctttgagaagagcaaggctgatccatctcactgggacaaaatctcccagggtggactcaagcgtattcatgagaagtacacatggcaaatttactcggacaggctcttgacactcactggtgtgtatggcttctggaagcacgtgaccaatcttgaacgccgtgagagcaaacgttacctcgagatgttctatgctctcaagtaccgcaaattggctgagtctgtgcccttgctattgaagagaaattcatgtttgaagag

SEQ ID NO: 2484 - DNA, 233 bp, Glycine max
  unsure (1)..(233): unsure at all n locations
ctcgagccgaatcggctcgagaacatcacaggactcgtggagtggcacggtaagaacgcgacctgnagggagttggtgaaccttgtggttgttgccggagacaggaggaaggagtcgaaggacttggaagagaaggccgagatgaagaagatgtacggcctgatcgagacctacaagttgaacgggcaattcagatggatttcatctcagatgaaccgtgtgaggaacggaga

SEQ ID NO: 2485 - DNA, 267 bp, Glycine max
atgagatgctcaaccgcatcaagaaacaaggccttgatatcacccctcgtattctcattatcactcgtcttctcgctgatgcagtaggaactacctgtggccaacgtctagagagggtatatgatactggctattggacattctcagagttcctttcagaacagaaaagggaattgttcgcaaatggatctcaagattcgaagtctggccatacctagagacttacactgaggatgtcggccttgaacttgccaaggagttgcaagc

SEQ ID NO: 2486 - DNA, 238 bp, Glycine max
ccgcaacaaaccaataatcttcaccatggcaaggcttgaccgtgtgaagaacatcacggggcttgtcgagtggtacgggaagcacgcacgcctccgcgagttggtgaacctggtggtggtggctggagacaggaggaaggagtcgaaggacttggaagagaaggccgagatgaagaagatgtatggcctcatcgagacctacaagttgaacggccaattcagatggatatcctctcag

SEQ ID NO: 2487 - DNA, 259 bp, Glycine max
  unsure (1)..(259): unsure at all n locations
gttaacagagttccaccccgancattgaanncgttctttacagntnagtggagaatgaagaacacatatgtgtattgaaggaccgcaaacaagncgatcatcttcaccatggcaagacttgaccgtgtgaagaacatcacgggacttgtggagtggtatggcaagaatgcgcgcctccgcgagttggtaaacctcgtggtggtggccggagacaggaggaaggagtccaaggacttggaagagaaggccgagatgaaga

SEQ ID NO: 2488 - DNA, 230 bp, Glycine max
cctcgacgccgagcgtgtcctcgagatgatccagcttctcttggaccttcttgaggcaaccgaccctaccaccctcgagaacttccttggaagagttcctatggtcttcaatgttgttatcctttctccccatggttactttgcccaagataatgtcttggggtaccctgacactggtggacaggttgtttacatcttggatcaagttcgtgccttggagaatgagatgc

SEQ ID NO: 2489 - DNA, 229 bp, Glycine max
gttctttgaaaagagcaaggctgacccatctcactgggacaaaatctcccagggtggactcaagcgtattcatgagaagtacacatggcaaatttactctgacaggctcttgacactcactggtgtgtatggcttctggaagcatgtgaccaatcttgaacgccgtgagagcaaacgttaccttgagatgttctatgctctcaagtaccgcaaattggctgagtctgtg

SEQ ID NO: 2490 - DNA, 257 bp, Glycine max
tattactcgtcttctccctgatgcagtaggaactacctgtggccaacgtctagagagggtatatcatactgaatattgtgacattctccgagttcctttcagaaccgaaaacggaattgttcgcaaatggatctcaacattcgaagtctggccatacctagagacttacactgaggatgttgcccttgaacttgccaaggagttgcaagccaagccagatctgatcgttggaaactacagtgatggaaacattgttg

SEQ ID NO: 2491 - DNA, 250 bp, Glycine max
acagactttatcatcaccagcaccttccaagagattgctggaagcaaggacactgttggacagtatgagagtcacactgccttcacccttccaggactttaccctgttgttcacggtattgatccatttgatccaaagttcaacattgtctctcccggtgcagacatgggcatatacctcccatacactgaaactgagcgtaggttaacagaattccactctgacatcgaagagcttctttacagctcag

SEQ ID NO: 2492 - DNA, 273 bp, Glycine max
  unsure (1)..(273): unsure at all n locations
gccaacgtttgccacatgcaatggtggtcctgctgagatcattgtgcatggnaaatctggttaccacattgatccttaacatggtgacatnctgctgagatccttgttgagttctttgagaagagcaaggctgatccatcctcactgggacaaaatctcccagggtggactcaagcgtattcatgagaagtacacatggcaaatttactcggacaggctcttgacactcactggtgtgtatggctctggaagcacgtgaccaatctgaacgcc

SEQ ID NO: 2493 - DNA, 245 bp, Glycine max
cggctcgaggtttatgaggcctttgggttgactgtggttgaggccatgacttgtgggttgccaacgtttgccacatgcaatggtggtcctgctgagatcattgtgcatggaaaatctggttaccacattgatccttaccatggtgaccatgctgctgagatccttgttgagttctttgagaagagcaaggctgatccatctcactgggacaaaatctcccagggtggactcaagcgtattcatga

SEQ ID NO: 2494 - DNA, 252 bp, Glycine max
  unsure (1)..(252): unsure at all n locations
taacaagttgaacggccaatacngatggatatcctnncagatgaaccgtgtgaggaacggagagctctaccgtgtcatctgtgacacaaggggtgcctttgtgcagcctgcagtttatgaggcctttgggttgactgtggttgaggccatgacttgtgggttgccaacgtttgccacatgcaatggtggtcctgctgagatcatgtgcaggaaaatctggttaccacatgatccntaccaggtgaccagctg

SEQ ID NO: 2495 - DNA, 261 bp, Glycine max
acaggactcgtggagtggtacggtaagaacgcgaactcgagggagttggtgaaccttgtggttgttgccggagacaggaggaaggagtcgaaggacttggaagagaaggccgagatgaagaagatgtacggcctgatcgagacctacaagttgaacgggcaattcagatggatttcatctcagatgaaccgtgtgaggaacggagagctgtaccgtgtgatctgcgacaccaagggagctttcgtgcagccggctatatac

SEQ ID NO: 2496 - DNA, 246 bp, Glycine max
caaagttcaacattgtctctcccggtgcagacatgggcatatacttcccatacactgaaactgagcgtaggttaacagaattccactctgacatcgaaacacttctttacagctcagtggagaatgaggaacacatatgcgtatgaaggaccgcaacaaaccaataatcttcaccatggcaaggcttgaccgtgtgaagaacatcacggggcttgtcgagtggtacgggaagaacgcacgcctccg

SEQ ID NO: 2497 - DNA, 261 bp, Glycine max
caggactttaccgtgttgttcacggtattgatccatttgatccaaagttcaacattgtctctcccggtgcagacatgggtatatacttcccatacactgaaactgagcgtaggttaacagaattccactctgacattgaagggcttctttacagctcagtggagaatgaggaacacatatgcgtattgaaggaccgcaacaaaccactaatcttcaccatggcaaggcttgaccgatgtgaagaacatcacggggcttgtc

SEQ ID NO: 2498 - DNA, 219 bp, Glycine max
gagatctacaagttgtacggccaattcagatggatatcctctcagatgaaccgtgtgaggaacggagagctctaccgtgtcatctgtgacacaaggggtgcctttgtgcagcctgcagtttatgaggcctttaggttgactttgggtaaggccatgacttgtgggtcgccaacgtttgccacatgcaatggtggtcctgctgagatcattgtgcatgga

SEQ ID NO: 2499 - DNA, 235 bp, Glycine max
caaggcttgaccgtgtgaagaacatcacggggcttgtcgagtggtacgggaagaacgcacgcctccgcgagttggtgaacctggtggtggtggctggagacaggaggaaggagtcgaaggacttgaagagaaggccgagatgaagaagatgtatggcctcatcgagacctacaagttgaacggccaattcagatggatatcctctcagatgaaccgtgtgaggaacggagagctc

SEQ ID NO: 2500 - DNA, 238 bp, Glycine max
acaaaatctcccagggtggactcaagcgtattcatgagaagtacacatggcaaatttactcggacaggctcttgacactcactggtgtgtatggcttctggaagcacgtgaccaatcttgaacgccgtgagagcaaacgttacctcgagatgttctatgctctcaagtaccgcaaattggctgagtctgtgccccttgctattgaagagtaaattcatgtttgaagagaacatcaatg

SEQ ID NO: 2501 - DNA, 264 bp, Glycine max
  unsure (1)..(264): unsure at all n locations
ctgaaactgagcgtaggttaacagaattccactctgacatcgaagcgcttctttacagctcagtggagaatgaggaacacatatgcgtattgaaggaccgcaacaaaccaataatcttcaccatggcaaggcttgaccgtgtgaagaacatcacggggcttgtcgagtggtacgggaagaacgcacgccttcgcgagattgntaaccatgctgatgntgcatgagacaggaggaaggagactgaagactttgaagagaaggccg

SEQ ID NO: 2502 - DNA, 257 bp, Glycine max
ctgaaactgagcgtaggttaacagaattccactctgacatcgaaacaattctttacagctcagtggagaatgaggaacacatatgcgtattgaaggaccgcaacaaaccaatatcttcaccatggcaaggcttgaccgtgtgaagaacatcacggggcttgtcgagtggtacgggaagaacgcacgcctccgcgagttggtgaacctggtggtggtggctggagacaggaggaaggagtcgaaggacttggaagaga

SEQ ID NO: 2503 - DNA, 175 bp, Glycine max
caacttctcttggatcttcttgaggcccctgacccttgcacccttgagactttccttggaagaattcctatggtcttcaatgttgtcattctttctccccatggttactttgcccaagattatgtcttgggataccctgacactggtggccaggttgtttacatcttggatcaag

SEQ ID NO: 2504 - DNA, 189 bp, Glycine max
gggaattgttcgcaaatggatctcaagattcgaagtctggccatacctagagacttacactgaggatgtcgccctggaacttgccaaggagttgcaagccaagctagatctgattgttggaaactacagtgatggaaacattgttgcctctttgttagcacataaattaggagtaactcagtgtacaat

SEQ ID NO: 2505 - DNA, 216 bp, Glycine max
gacatcgaagagcttctttacagctcagtggagaatgaggaacacatatgcgtattgaaggaccgcaacaaaccaataatcttcaccatggcaaggttgaccgtgtgaagaacatcacggggcttgtcgagtggtacgggaagaaacgaaggcttcgcgagttggtgaactggtggtggtggctgaagacaggaggaaggattcgaggctttgaaa

SEQ ID NO: 2506 - DNA, 246 bp, Glycine max
ctcgagccgaatcggctcgagcggctcgagcggctcgagatgaagcacacatatgtgtattgaaggaccgcaacaagccgaacatcttcaacatggcaagacttgaccgtgtgaagaacatcacgggacttgtggagtggtatggcaagaatgcgcgcctccgcgagttggtaaacctcgtggtggtggacggagacaggaggaaggagtccaaggacgttgaagagaaggccgagatgaagaaga

SEQ ID NO: 2507 - DNA, 239 bp, Glycine max
tgaagaagatgtacggcctgatcgagacctacaagttgaacggccaattcagatggatttcatcgcagatgaaccgtgtgaggaatggagagctctaccgcgtgatctgcgacaccaggggtgctttcgtgcagcctgctgtatacgaggcttttggtttgacagtggttgaggccatgacttgcggcttgccaacattcgccacatgcaatggtggtcctgctgagatcattgtgcac

SEQ ID NO: 2508 - DNA, 269 bp, Glycine max
gggtggactcaagcgtattcatgagaagtacacatggcaaatttactcggacaggctcttgacactcactggtgtgtatggcttctggaagcacgtgaccaatcttgaacgccgtgagatgaaacgttacctcgagatgttctatgctctcaagtaccgcaaattggctgagtctgtgccccttgctattgacgagtaaattcatgtttgaagagaacatcaatggcgaaaccggcttttggtcgtttgaagtcttatggagctttcat

SEQ ID NO: 2509 - DNA, 184 bp, Glycine max
aactcagtgtaccattgctcatgctctagaaaagaccaagtaccctgagtctgacatttactggaaaaaatttgaagagaaatatcatttctcatgccaatttactgctgatctttttgcaatgaaccacacagactttatcatcaccagcaccttccaagagattgctggaagcaaggacact

SEQ ID NO: 2510 - DNA, 229 bp, Glycine max
ggatcaagttcgtgccttggagaatgagatgctcaaccgcatcaagaaacaaggccttgatatcacccctcgtattctcattattactcgtcttctccctgatgcagtaggaactacctgtggcgaacgtctagagagggtatatgatactgaatattgttacattctccgcggtcctgtcagaactgaggagggacttgttcgcaaatggagctgaagattcgaagtc

SEQ ID NO: 2511 - DNA, 215 bp, Glycine max
  unsure (1)..(215): unsure at all n locations
atcaccagcaccttccaagagattgctggaagcaaggacactgttggacantatgagagtcacactgccttcacccttccaggactttaccgtgttgttcacggtattgatccatttgatccaaagttcaacattgtctctcccggtgncgacatgggtatatacttcccatacactgaaactgagcgtaggttaacagaattccacacaacata

SEQ ID NO: 2512 - DNA, 235 bp, Glycine max
atttgatccaaagttcaacattgtctctcccggtgcagacatgggtatatacttcccatacactgaaactgagcgtaggttaacagaattccactctgacattgacgaagctctttacagctcagtggagaatgaggaacacatatgcgtattgaaggaccgcaacaaaccaataatcttcaccatggcaaggcttgaccgtgtgaagaacatcacggggcttgtcgagtggtac

SEQ ID NO: 2513 - DNA, 253 bp, Glycine max
tctcgagcgattcggatcacggctcgaggttcacggtattgacccatttgatccaaagctcaacattgtctctcccggtgcagacatgggtatatacttcccatacactgaaactgagcgtaggttaacagaattccactctgacattgaagagcttctttacagctcagtggagaatgaggaacacatatgcgtattgaaggaccgcaacaaaccaataatcttcaccatggcaaggcttgaccgtgtgaag

SEQ ID NO: 2514 - DNA, 250 bp, Glycine max
cggtgcagacatgggtatatacttcccatacactgaaactgagcgtaggttaacagaattccactctgacattgaaacacctctttacagctcagtggagaatgaggaacacatatgcgtattgaaggaccgaacaaaccaataatcttcaccatggcaaggcttgacgctggtgaagaactccacggggcttgtcgagtggtacgggaagaacgcacgcctccgcgagttggtgaacctggtggtggtg

SEQ ID NO: 2515 - DNA, 269 bp, Glycine max
  unsure (1)..(269): unsure at all n locations
tcgactggtacgggaagaacgcacgcctccgcgagttggtgaacctggtggtggtggcnggagacaggangaaggagtcnaaggacttggaagagaaggccgagntgangaanntgtanggctcatcgagacctacaagttgaacggccaattcagatgnatatcntctgcagatgaaccgtgtgaggaacgganagctctaccgtgtccatctgtgacacaaggngtgctttgtgncagcctgcagtttatgaggcntngggttganc

SEQ ID NO: 2516 - DNA, 227 bp, Glycine max
  unsure (1)..(227): unsure at all n locations
cagactttatcatcaccagcaccttccaagagattgctggaataanggacactgttggacagtatgagagtcacactgccttcacccttccaggactttaccgtgttgttcacggtattgatgcctttgatccaaagttcaacattgtctctcccggtgcagacatgggtatatacttcccatacactgaaactgagcgtaggttaacagaattccacactgcatac

SEQ ID NO: 2517 - DNA, 244 bp, Glycine max
  unsure (1)..(244): unsure at all n locations
gtatatacttcccatacactgaaactgagcgtaggttaacagaattccactctgacattgaatctcttctttacagctcagtggagaatgaggaacacatatgcgtattgaaggaccgcaacaaaccataatcttcaccatggcaatgcttgacgtgttgaagaacatcacggggcttgtcgagtggtacgggaagaacgcacgcctccgcgagttgngtgaactggtggtggtggctggagac

SEQ ID NO: 2518 - DNA, 260 bp, Glycine max
ccggtgcagacatgggcatatacttcccatacactgaaactgagcgtaggttaacagaattccactctgacatcgaactacttctttacagctcagtggagaatgaggaacacatatgcgtattgaaggaccgcaacaaaccaataatcttcaccatggcaaggcttgaccgttgtgaagaacatcacggggcttgtcgagtggtacgggaagaacgcacgcctccgcgagttggtgaacctggtggtggtagctggaga

SEQ ID NO: 2519 - DNA, 177 bp, Glycine max
  unsure (1)..(177): unsure at all n locations
tctaccgtgtcatctgtgacacaaggggtgcctttgtgcagcctgcagtttatgaggcctttgggttgactgtggttgaggccatgacttgtgggttaccaacatttgccacatgcaatggtggtcctnctgagatcattgtgcatggaaaatctggtnaccacntnncncccttnt

SEQ ID NO: 2520 - DNA, 244 bp, Glycine max
atagagagggtatactgatactgaatattgtgacattctcagagttcctttcagaacagaaaagggaattgttcgcaaatggatctcaagattcgaagtctggccatacctagagacttacactgaggatgtcgcccttgaacttgtcaaggagttgaagccaagtcagatctgattgttggaaactacagtgatggaaacattgttgcctctttgttagcacataaattaggagtcactcagt

SEQ ID NO: 2521 - DNA, 259 bp, Glycine max
gtaaatgtcggattcggggtatttggtcttctcaagtgcatgagcaatggtacactgagtgactcctaatttatgtgccaacaaagaggcaacaatgtttccatcactgtagtttccgacaatcagatctcattatcaccagtaccttccaggagattgctggaagcaaggacactgttggacagtatgactctcacacagcctttacccttcctggactctaccgtgttgtgcacggcattgatgtctttgatccaaa

SEQ ID NO: 2522 - DNA, 239 bp, Glycine max
cggacaggctcttgacactcactggtgtgtatggcttctggaagcacgtgaccaatcttgaacgccgtgagagcaaacgttacctcgagatgttctatgctctcaagtaccgcaaattggctgagtctgtgccccttgctattgaagagtaaattcatgtttgaagagaacatcaatggagaaaccggcttttggtcgtttgaagtcttatggagctttcataaataacgccattgatt

SEQ ID NO: 2523 - DNA, 235 bp, Glycine max
cggacaggctcttgacactcactggtgtgtatggcttctggaagcacgtgaccaatcttgaacgccgtgagagcaaacgttacctcgagatgttctatgctctcaagtaccgcaaattggctgagtctgtgccccttgctattgaagagtaaattcatgtttgaagagaacatcaatggagaaaccggcttttggtcgtttgaagtcttatggagctttcataaataacgccatt

SEQ ID NO: 2524 - DNA, 143 bp, Glycine max
ctcgagccgcaccagtaccttccaggagattgctggaagcaaggacactgttggacagtatgcgtctcacacagcctttacccttcctggactctaccgtgttgtgcacggcattgatgtctttgatccaaaattccacattg

SEQ ID NO: 2525 - DNA, 142 bp, Glycine max
gtcggaaactacagtgatggaaacattgttgcctctttgttggcacataaattaggagtcactcagtgtaccattgctcatgcacttgagaagagcgaataccccgaatccgacatgtactggacaagattgggagagaggt

SEQ ID NO: 2526 - DNA, 254 bp, Glycine max
ctcactggtgtgtatggcttctggaagcacgtgaccaatcttgaacgccgtgagagcaaacgttacctcgagatgttctatgctctcaagtaccgcaaattggctgagtctgtgccccttgctattgaagagtaaattcatgtttgaagagaacatcaatggagaaaccggcttttggtcgtttgaagtcttatggagctttcataaataacgccattgattttgattgtgatcagcttttggatttaaagagt

SEQ ID NO: 2527 - DNA, 131 bp, Glycine max
  unsure (1)..(131): unsure at all n locations
cttgtggttgttgccgganacaggagtnaggagtcgaaggacttgnaagagaaggccgagatgnnnaagatgtacggcctgatcnananctacnagttgaacgggnaattcagatggnnnncatctcagat

SEQ ID NO: 2528 - DNA, 161 bp, Glycine max
tatgagagtcacactgccttcacccttccaggactctaccgtgttgttcacggtattgatccctttgatccaaagttcaacatcgtctctcccggtgccgacatgagcatatacttcccatacactgaaactgaacgtaggttaacagagttccacacaac

SEQ ID NO: 2529 - DNA, 152 bp, Glycine max
ctggactctaccgcgttgtgcatggtattgatgtctttgatccaaaattcaacattgtctcccctggagctgatcaaaccatttacttcccccacactgaaaccagccgtaggttgacatccttccaccctgaaatcgaagaactcctttac

SEQ ID NO: 2530 - DNA, 232 bp, Glycine max
ctgaaactgagcgtagggtaacagaattccactctgagatcgaagcgcttctttacagctcagtggagaatgaggaacacatatgcgtattgaaggaccggaacaaacgaatatcttcaccatggcaaggcttgaccgtgtgaagaacatcacggggcttgtcgagtggtacgggaagaacgcaagcctccgcgagttggtgaacctggtggtggtggctggagacaggagg

SEQ ID NO: 2531 - DNA, 244 bp, Glycine max
ttcgacacgcacggccaggctcttgacactcaccggtgtgtatggcacctggaagcccgtgaccaatcgcgaacgccgtgagagcaaacgctacgccgagatgttccaagctactcaagtaccgcaaattggctgagtctgtgccccttgctactgaagagtaacttcatgtttgaagagaacatcaatggagacaccggcttttggtcgtttgaagtcttatggagctttcataaataacgcc

SEQ ID NO: 2532 - DNA, 279 bp, Glycine max
attcttgagttcatggaagggaaaccagatcttgttattggaaattacactgatggaaatttggtagcatcactaatggctagaaaacttgggataactcagggaactatagcacatgctttagagaagaccaagtatgaagactcagatgtcaagtggaaagagttggaccccaagtaccacttctcgtgtcaattcatggcggatacagtggcaatgaatgcatctgatttcatcataaccagcacataccacgaatgtcgtggaagcaaagataga

SEQ ID NO: 2533 - DNA, 244 bp, Glycine max
gttcatggaagggaaaccagatctagttattggaaattacactgatggaaatttggtagcatcactaatggctagaaaacttgggataactcagggaactatagcacatgctttagagaagaccaagtatgaagactcagatgtcaagtggaaagagttggaccccaagtaccacttctcgtgtcaattcatggcggatacagtggcaatgaatgcatctgatttcatcataaccagcacatac

SEQ ID NO: 2534 - DNA, 262 bp, Glycine max
gccgtgagagccgccgctatctcgagatgttctatgctctcaagtaccgcaaattggctgagtctgtgccccttgctgctgagtaaactgaggataaagagttggataaagaaatggaggaaccggctttttctttctcatttggagtttgtcgcacttgagttttataaataatgtccgtgattttagttttgtgattaagctttcgataagaggagagaaagagaaggaaaaaaaagttgcttttttttttggtggttgc

SEQ ID NO: 2535 - DNA, 266 bp, Glycine max
tcgagatgttctatgctctcaagtaccgcaaattggctgagtctgtgccccttgctgctgagtaaactgaggataaagagttggataaagaaatggaggaaccggctttttctttctcatttggagtttgtcgcacttgagttttataaataatgtccgtgattttagttttgtgattaagctttcgataagaggagagaaagagaaggaaaaaaaaagttgcttttttttttgttgttgcatgattgggacttgattggaaaagc

SEQ ID NO: 2536 - DNA, 241 bp, Glycine max
gttggataaagaaatggaggaaccggctttttctttctcatttggagtttgtcgcacttgagttttataaataatgtccgtgattttagttttgtgattaagctttcgataagaggagagaaagagaaggaaaaaaaaagttgcttttttttttgttgttgcatgatttggatcttgattggaaaagcttcgaattggggtagttttacccagcaattcaattttaagccgtgccttcttc

SEQ ID NO: 2537 - DNA, 274 bp, Glycine max
ctctcaagtaccgcaaattggctgagtctgtgccccttgctgctgagtaaactgaggataaagagttggataaagaaatggaggaaccggctttttctttctcatttggagtttgtcgcacttgagttttataaataatgtccgtgattttagttttgtgattaagctttcgataagaggagagaaagagaaggaaaaaaaaagttgcttttttttttgttgttgcatgatttggatcttgattggaaaagcttcgaattggggtagttttacc

SEQ ID NO: 2538 - DNA, 275 bp, Glycine max
atttttaccttgaaatatgttgtcattgaacttgctaatgtatcttgttattgtttttacctttaggctgagtctgtgccccttgctgctgagtaaactgaggataaagagttggataaagaaatggaggaaccggctttttctttctcatttggagtttgtcgcacttgagttttataaataatgtccgtgattttagttttgtgattaagctttcgataagaggagagaaagagaaggaaaaaaaaagttgcttttgtttttgttgttgcatg

SEQ ID NO: 2539 - DNA, 256 bp, Glycine max
gccgtgagagccgccgctatctcgagatgttctatgctctcaagtaccgcaaattggccgagtctgtgccccttgctgttgagtaaactgaggatgaagagttggataaagaaatggaggaaccggctttttgtttctcatttggagtttgtcttacttgagttctataaataatatgtccctgatgattttaattttgtgattaagctttcgataagagacagagagagaaaaaaaaaaaaaaaaaaaggggggg

SEQ ID NO: 2540 - DNA, 259 bp, Glycine max
  unsure (1)..(259): unsure at all n locations
cntgtgtctaaccttgaccgccgtgagagccgccgctatctcgagatgttctatgctctcaagtaccgcaaattggccgagtctgtgccccttgctgttgagtaaactgaggatgaagagttggataaagaaatggaggaaccggctttttgtttctcatttggagtttgtcttacttgagttctataaataatatgtccctgatgattttaattttgtgattaagctttcgataagagacagagagagaaaaaaaagg

SEQ ID NO: 2541 - DNA, 250 bp, Glycine max
gccgctatctcgagatgttctatgctctcaagtaccgcaaattggccgagtctgtgccccttgctgttgagtaaactgaggatgaagagttggataaagaaatggaggaaccggctttttgtttctcatttggagtttgtcttacttgagttctataaataatatgtccctgatgattttaattttgtgattaagctttcgataagagacagagagagaaaaaaaaggaaaaaaaaaaaaaagcctttta

SEQ ID NO: 2542 - DNA, 189 bp, Glycine max
gtgagagccgccgctatctcgagatgttctatgctctcaagtaccgcaaattggccgagtctgtgccccttgctgttgagtaaactgaggatgaagagttggataaagaaatggaggaaccggctttttgtttctcatttggagtttgtcttacttgagttctataaataatatgtccctgatgatttt

SEQ ID NO: 2543 - DNA, 229 bp, Glycine max
gccgtgagagccgccgctatctcgagatgttctatgctctcaagtaccgcaaattggccgagtctgtgccccttgctgttgagtaaactgaggatgaagagttggataaagaaatggaggaaccggctttttgttctcatttggagtttgtcttacttgagttctataaataatatgtccctgatgattttaattttgtgattaagctttcgataagagacagagagag

SEQ ID NO: 2544 - DNA, 223 bp, Glycine max
ctttaggccgagtctgtgccccttgctgttgagtaaactgaggatgaagagttggataaagaaatggaggaaccggctttttgtttctcatttggagtttgtcttacttgagttctataaataatatgtccctgatgattttaattttgtgattaagctttcgataagagacagagagagaaaaaaaaggaaaaaaaaaaaagccttttactttttgtctttt

SEQ ID NO: 2545 - DNA, 282 bp, Glycine max
ctcgagccgcaagacctggtgtgtgggagtacctgagagtgaatgtgcacgctcttgttgttgaggagttgcaacctgctgagtacctgcacttcaaggaagaacttgttgacggaagttctaatggcaactttgtgcttgagttggactttgaaccattcaatgcagccttcccccgcccaactcttaacaaggcaattggaaatggtgtgcaagacctcaaccgtcacctttctgccaaactcttccacgacaaggtgagcagacacccacttttggagt

SEQ ID NO: 2546 - DNA, 271 bp, Glycine max
  unsure (1)..(271): unsure at all n locations
gttgcaacctgctgagtaccttcacttcaaggaagaacttgttgatggaagttctaatggcaactttgtgcttgagttggactttgaaccattcaatgcagccttccctcgcncannnccttaacaagtcaattggaaatggtgtgcagttcctcaaccgccacctttctgccaaactcttccacgaaaangaaaaatggaaaaanacttttggaattcctcaggcttcacagcgtcaagggaaagactttgatgttgaatgacagaatca

SEQ ID NO: 2547 - DNA, 214 bp, Glycine max
tgtgcacgctcttgttgttgaggagttgcaacctgctgagtacctgcacttcaaggaagaacttgttgacggaagttctaatggcaactttgtgcttgagttggactttgaaccattcaatgcagccttcccccgcccaactcttaacaagtcaattggaaatggtgtgcaattcctcaaccgtcacctttctgccaaactcttccacacaaca

SEQ ID NO: 2548 - DNA, 87 bp, Glycine max
tggactttgaaccattcaatgcagccttccctcgcccaactcttaacaagtcaattggaaatggtgtgcagttcctcaaccgccacc

SEQ ID NO: 2549 - DNA, 333 bp, Glycine max
  unsure (1)..(333): unsure at all n locations
ctttacacccccctctctattttgcgttcattctgttttcttgaagtctttccctagccaatggccactgatcgtttgacccgggtnncacagtctccgtgagaggcttgatgaaaccctcactgccaacgggaacgaaattttggcccttctgtcaaggatcgagctaagggcaaggggatcctgcaacaccaccaggtcattgctgagtttgaggaaatccctgaggagaacaggcagaagcttactgatggtgcctttggagaagtcttgagatctacacaggaagccatagttttgccaccatgggttgctctggctgttcgtccaagc

SEQ ID NO: 2550 - DNA, 291 bp, Glycine max
ccccctctcttttttgcgttcattctgttttcctgatgaagtctttccctagccaatggccaccgatcgtttgacccgggttcacagtctccgtgagaggcttgatgaaaccctcactgccaacaggaatgaaattttggcccttctgtcaaggatcgaagccaagggcaagggcatcctgcaacaccaccaggtcattgctgagtttgaggaaatccctgaggagaacagacagaagctcactgatggtgcctttggagaagtcttgagatctacacaggaagccatagt

SEQ ID NO: 2551 - DNA, 298 bp, Glycine max
  unsure (1)..(298): unsure at all n locations
cgttcattctgttttcagttgaagtctttcnctagccaatggccactgatcgtttgacncgtnntcacagtcnccgtgagaggcttgatgaaaccctcactgccaacaggaacgaaattttggcccttctgtcaaggatcgaagctaagggcaaggggatcctgcaacaccaccaggtcattgctgagtttgaggaaatccctgaggagaacaggcagaagcttactgatggtgcctttggagaagtcttgagatctacacaggaagccatagttttgccaccatgggttgctctggc

SEQ ID NO: 2552 - DNA, 262 bp, Glycine max
ttttcctgttgaagtctttccctagccaatggccaccgatcgtttgacccgggttcacagtctccgtgagaggcttgatgaaaccctcactgccaacaggaatgaaattttggcccttctgtcaaggatcgaagccaagggcaagggcatcctgcaacaccaccaggtcattgctgagtttgaggaaatccctgaggagaacagacagaagctcactgatggtgcctttggagaagtcttgagatctacacaggaagccata

SEQ ID NO: 2553 - DNA, 291 bp, Glycine max
  unsure (1)..(291): unsure at all n locations
cccctctctattttgcgttcattctgttttccagttgaagtctttccctagccaatggccactgatcgtttgacccgggttcacagtctccgtgagaggcttgatgaaaccctcactgccaacaggaacgaaattttggcccttctgtcaaggatcgaagctaagtancaaggggatcctgcaacaccaccaggtcattgctgagtttgaggaaatccctgaggagaacaggcagaagcttactgatggtgcctttggagaagtcttgagatctacacaggaagccatagt

SEQ ID NO: 2554 - DNA, 247 bp, Glycine max
ctcactgccaacaggaatgaaattttggcccttctgtcaaggatcgaagccaagggcaagggcatcctgcaacaccaccaggtcattgctgagtttgaggaaatccctgaggagaacagacagaagctcactgatggtgcctttggagaagtcttgagatctacacaggaagccatagttttgccaccatgggttgctctggctgttcgtccaagacctggtgtgtgggagtacctgagagtgaatg

SEQ ID NO: 2555 - DNA, 268 bp, Glycine max
tctttataccccccctctcttttttgcgttcattctgttttcctgttgaagtctttccctagccaatggccaccgatcgtttgacccgggttcacagtctccgtgagaggcttgatgaaaccctcactgccaacaggaatgaaattttggcacttctgtcaaggatcgaagccaagggcaagggcatcctgcaacaccaccaggtcattgctgagtttgaggaaatccctgaggagaacagacagaagctcactgatggtgcctttgg

SEQ ID NO: 2556 - DNA, 260 bp, Glycine max
tctctttataccccccctctcttttttgcgttcattctgttttcctgttgaagtctttccctagccaatggccaccgatcgtttgacccgggttcacagtctccgtgagaggcttgatgaaaccctcactgccaacaggaatgaaattttggcccttctgtcaaggatcgaagccaagggcaagggcatcctgcaacaccaccaggtcattgctgagtttgaggaaatccctgaggagaacagacagaagctcactgatg

SEQ ID NO: 2557 - DNA, 261 bp, Glycine max
cccccctctcttttttgcgttcattctgttttcctgttgaagtctttccctagccaatggccaccgatcgtttgacccgggttcacagtctccgtgagaggctggatgaaaccctcactgccaacaggaatgaaattttggcccttctgtcaaggatcgaagccaagggcaagggcatcctgcaacaccaccaggtcattgctgagtttgaggaaatccctgaggagaacagacagaagctcactgatggtgcctttggag

SEQ ID NO: 2558 - DNA, 254 bp, Glycine max
ctttataccccccctctcttttttgcgttcattctgttttcctgatgaagtctttccctagccaatggccaccgatcgtttgacccgggttcacagtctccgtgagaggcttgatgaaaccctcactgccaacaggaatgaaattttggcccttctgtcaaggatcgaagccaagggcaagggcatcctgcaacaccaccaggtcattgctgagtttgaggaaatccctgaggagaacagacagaagctcactg

SEQ ID NO: 2559 - DNA, 243 bp, Glycine max
gcgttcattctgttttcctgttgaagtctttccgtagccaatggccaccgatcgtttgacccgggttcacagtctccgtgagaggcttgatgaaaccctcactgccaacaggaatgaaattttggcccttctgtcaaggatcgaagccaagggcaagggcatcctgcaacaccaccaggtcattgctgagtttgaggaaatccctgaggagaacagacagaagctcactgatggtgcctttgg

SEQ ID NO: 2560 - DNA, 271 bp, Glycine max
ctttacacccccctctctattttgcgttcattctgttttccagttgaagtctttccctagccaatggccactgatcgtttgacccgggttcacagtctccgtgagaggcttgatgaaaccctcactgccaacaggaacgaaattttggcccttctgtcaaggatcgaagctaagggcaaggggatcctgcaacaccaccaggtcattgctgagtttgaggaaatccctgaggagaacaggcagaagcttactgatggtgcctttggagaag

SEQ ID NO: 2561 - DNA, 255 bp, Glycine max
ctctattttgcgttcattctgttttccagttgaagtctttccatagccaatggccactgatcgtttgacccgggttcacagtctccgtgagaggcttgatgaaaccctcactgccaacaggaacgaaattttggcccttctgtcaaggatcgaagctaagggcaaggggatcctgcaacaccagcaggtcattgctgagtttgaggaaatccctgaggagaacaggcagaagcttactgatggtgcctttggaga

SEQ ID NO: 2562 - DNA, 233 bp, Glycine max
ttttgcgttcattctgttttcctgttgaagtctttccctagccaatggccaccgatcgtttgacccgggttcacagtctccgtgagaggcttgatgaaaccctcactgccaacaggaatgaaattttggcccttctgtcaaggatcgaagccaagggcaagggcatcctgcaacaccaccaggtcattgctgagtttgaggaaatccctgaggagaacagacagaagctcact

SEQ ID NO: 2563 - DNA, 262 bp, Glycine max
gttcattctgttttcttgaagtctttccctagccaatggccactgatcgtttgacccgggttcacagtctccgtgagaggcttgatgaaaccctcactgccaacaggaacgaaattttggcccttctgtcaaggtcgaagctaagggcaaggggatcctgcaacaccaccaggtcattgctgagtttgaggaaatccctgaggagaacaggcagaagcttactgatggtgcctttggagaagtcttgagatctacacaggaa

SEQ ID NO: 2564 - DNA, 237 bp, Glycine max
gcgttcattctgttttcctgttgaagtctttccctagccaatggccatcgatcgtttgacccgggttcacagtctccgtgagaggcttgatgaaaccctcactgccaacaggaatgaaattttggcccttctgtcaaggatcgaagccaagggcaagggcatcctgcaacaccaccaggtcattgctgagtttgaggaaatccctgaggagaacagacagaagctcactgatggtgc

SEQ ID NO: 2565 - DNA, 268 bp, Glycine max
ctttacacccccctctctattttgcgttcattctgttttccagttgaagtctttccctagccaatggccactgatcgtttgacccgggttcacagtctccgtgagaggcttgatgaaaccctcactgccaacaggacgaaattttggcccttctgtcaaggatcgaagctaagggcaaggggatcctgcaacaccaccaggtcattgctgagtttgaggaaatccctgaggagaacaggcagaagcttactgatggtgcctttggaga

SEQ ID NO: 2566 - DNA, 268 bp, Glycine max
  unsure (1)..(268): unsure at all n locations
cttctctttacacccccctcncctattttgcgttcattctgttttccagttgaagtctttccctagccaatggccactgatcgtttgacccgggttcacagtctccgtgagaggcttgatgaaaccctcactgccaacaggaacgaaattttggcccttctgtcaaggatcgaagctaagggcaaggggatcctgcaacaccaccaggtcattgctgagtttgagganatccctgaggagaacaggcagaagcttnctgatggngnct

SEQ ID NO: 2567 - DNA, 237 bp, Glycine max
cgttcattctgttttcctgttgaagtctttccctagccaatggccaccgatcgtttgacccgggttcacagtctccgtgagaggcttgatgaaaccctcactgccaacaggaatgaaattttggcccttctgtcaaggatcgaagccaagggcaagggcatcctgcaacaccaccaggtcattgctgagtttgaggaaatccctgaggagaacagacagaagctcactgatggtgcc

SEQ ID NO: 2568 - DNA, 261 bp, Glycine max
cttctctttacacccccctctctattttgcgttcattctgtcttcttgaagtctttccctagccaatggccactgatcgtttgacccgggttcacagtctccgtcagaggcttgatgaaaccctcactgccaacaggaacgaaattttggcccttctgtcaaggatcgaagctaagggcaacgggatcttgcaacaccaccaggtcattgctgagtttgaggaaatccctgaggagaacaggcagaagcttactgatggtg

SEQ ID NO: 2569 - DNA, 263 bp, Glycine max
acacccccctctctattttgcgttcattctgttttacagttgaagtctttccatagccaatggccactgatcgtttgacccgggttcacagtctccgtgagaggcttgatgaaaccctcactgccaacaggaacgaaattttggcccttctgtcaaggatcgaagctaagggcaaggggatcctgcaacaccaccaggtcattgctgagtttgaggaaatcctgaggagaacaggcagagcttactgatggtgctatggagaa

SEQ ID NO: 2570 - DNA, 229 bp, Glycine max
ctgttttccagttgaagtctttccctagccaatggccactgatcgtttgacccgggttcacagtctccgtgagaggcttgatgaaaccctcactgccaacaggaacgaaattttggcccttctgtcaaggatcgaagctaagggcaaggggatcctgcaacaccaccaggtcattgctgagtttgaggaaatccctgaggagaacaggcagaagcttactgatggtgcc

SEQ ID NO: 2571 - DNA, 265 bp, Glycine max
  unsure (1)..(265): unsure at all n locations
cttctctttacacccccctctctattttgcgttcattctgttttccagttgaagtctttccctagccaatggccactcgatcgtttgacncggggtcacagtctccgtgagaggcttgatgaaaccctcactgccaacaggaacgaaattttggcccttctgtcaaggatcgaagctaagggcaaggggatcctgcaacaccaccaggtcattgctgagtttgaggaaatccctgaggagaacaggcagaagcttactgatggtg

SEQ ID NO: 2572 - DNA, 264 bp, Glycine max
gttcattctgttttcttgaagtctttccctagccaatggccactgatcgtttgacccgggttcacagtctccgtgagacgcttgatgaaaccctcactgccaacaggaacgaaattttggcccttctgtcaaggatcgaagctaagggcaaggggatcctgcaacaccaccaggtcattgctgagtttgaggaaatccctgaggagaacaggcagaagcttactgatggtgcctttggagaagtcttgagatctacacaggaag

SEQ ID NO: 2573 - DNA, 252 bp, Glycine max
ctttataccccccctctctttttttgcgttcattctgttttcctgttgaagtctttccctagccaatggccaccgatcgtttgacccgggttcacagtctccgtgagaggcttgatgaaaccctcactgccaacaggaatgaaattttggcccttctgtcaaggatcgaagccaagggcaagggcatcctgcaacaccaccaggtcattgctgagtttgaggaaatccctgaggagaacagacagaagctca

SEQ ID NO: 2574 - DNA, 242 bp, Glycine max
ctctttataccccccctctcttttttgcgttcattctgttttcctgttgaagtctttccctagcaaatggccaccgatcgtttgacccgggttcacagtctccgtgagaggcttgatgaaaccctcactgccaacaggaatgaaattttgggccttctgtcaaagatcgaagccaagggccaaggcatcctgcaacaccaccaggtcattgctgaatttgaggaaatccctgaggagaacag

SEQ ID NO: 2575 - DNA, 269 bp, Glycine max
tctttatatcccccggcgcttgtgtgcggtcattctgttttgctgttgaagtcggtcctagccagtgggcaccgatcgtttgacccgggttcacagtctccgtgagaggcttgatgaaaccctcactgccaacaggaatgaaattttggcccttctgtcaaggatcgaagccaagggcaagggcatcgtgcaacaccaccaggtcattgctgagtttgaggaaatccctgatgagaacagacagaagctcactgatggtgcctttggag

SEQ ID NO: 2576 - DNA, 255 bp, Glycine max
attcggctcgagcttctctttacacccccctctctattttgcgttcactctgtattccagttgacgtctttccctagccaatggccactgatcgcttgacccgggttcacagtctccgtgagaggcttgatgataccctcactgccaacaggatcgaaattttggcccttctgtcaaggatcgaagctaagggcaaggggatcctgcaacaccaccaggtcattgctgagtttgaggaaatccctgaggagaaca

SEQ ID NO: 2577 - DNA, 142 bp, Glycine max
acccccctctctattttgcgttcattctgttttccagttgaagtctttccctagccaatggccactgatcgtttgacccgggttcacagtctccgtgagaggcttgatgaaaccctcactgccaacaggaacgaaattttgg

SEQ ID NO: 2578 - DNA, 158 bp, Glycine max
ctttacaccccctctctattttgcgttcattctgttttccagttgaagtctttccctagccaatggccactgatcgtttgacccgggttcacagtctccgtgagaggcttgatgaaaccctcactgccaacaggaacgaaattttggcccttctgtca

SEQ ID NO: 2579 - DNA, 132 bp, Glycine max
cttctctttacacccccctctctattttgcgttcattctgtttaccagttgaagtctttccctagccaatggccactgatcgtttgacccgggttcacagtctccgtgagaggcttgatgaaaccctcactg

SEQ ID NO: 2580 - DNA, 259 bp, Glycine max
gtgcccttgaaaatgagatgctccttcggatcaagaaacagggacttgatttcactccaagaattctaatagttaccaggttaatacctgatgcaaaggggacaacatgcaaccagcggctagaaagagtcagtggtactgaccatactcatattttgcgagttccattcagatcagagtcaggaactctccgtaaatggatttcaaggtttgatgtgtggccttatctagagacttatgcagaggatgttgccagtga

SEQ ID NO: 2581 - DNA, 221 bp, Glycine max
tgatttcactccaagaattctaatagttaccaggttaatacctgatgcaaaggggacaacatgcaaccagcggctagaaagagtcagtggtactgaccatactcatattttgcgagttccattcagatcagagtcaggaactctccgtaaatggatttcaaggtttgatgtgtggccttatctagagacttatgcagaggatgttgccagtgaaattgctg

SEQ ID NO: 2582 - DNA, 437 bp, Glycine max
ctctcatgcttttttccacttgcaaacttcaaattcactctgacagtttttgcagctaagtaagaagaacttaacagacatataaacatagtgatcgttatgtctacgcaaccaaagcttggtcggattcccagtatcagagaccgagttgaagacactctctctgctcaccgtaacgaactcatttctctcctctccaggtatgtggctcaagggagagggattttgcaaccccataatttgattgatgaacttgacaacatccctggcgatgatcaagcaatagtggatcttaaaaatggtccctttggtgaaatcgtcaagtctgcaaaggaagccatagttttgcctccttttgtggcaatagcagttcgtccaagacctggtgtttgggaatatgtccgtgttaatgtctctgagctcagcgtggagcaatt

SEQ ID NO: 2583 - DNA, 394 bp, Glycine max
cacgcgtcagggataccttgcagcccttgcttgatttcctccgagctcacaaatacaagggccatgctctgatgttaaatgatagaatacaaaccatttccaaacttcagtctgcattggccaaggctgaggattatctctctaagcttgcacatgatacactctattcagagtttgaatatgtattgcaaggaatgggttttgagagaggttggggtgatactgctgaacgggtattggaaatgatgcatctgctattggatattcttcaggctcctgatccttctacactagagacttttcttgggagagtaccaatggtattcaatgttgctatattatctcctcatggctactttggacaagccaatgtcttgggtttgcctgaaactgg

SEQ ID NO: 2584 - DNA, 391 bp, Glycine max
tacggctgcgagaagacgacagaagggggaagagaaggccgagatgaagaagatgtacggcctgatcgagacctacaagttgaacgggcaattcagatggatttcatctcagatgaaccgtgtgaggaacggagagctgtaccgtgtgatctgcgacaccaagggagctttcgtgcagccggctatatacgaggcttttggtttgacagtggttgaggccatgacttgtgggttgccaacattcgccacatgcaatggtggtcctgctgagatcattgtgcatggcaagtctggcttccacattgacccttaccatggtgaccgtgctgctgatctccttgttgacttctttgagaagtgcaagcttgacccaacccactgggaaacaatc

SEQ ID NO: 2585 - DNA, 398 bp, Glycine max
  unsure (1)..(398): unsure at all n locations
cccacgcgtccgcccacgcgtccgcccacgcgtccgcccacgcgtccgcggctgcgagaagacgacagaaggggtacggcctgatcgagacccacaagttgaacggccaattcagatggatttcatcgcagatgaaccgtgtgaggaatggagagctctaccgcgtgatctgcgacaccaggggtgctttcgtgcagcctgctgtatacgaggcttttggtttgacagtggttgaggccatgacttgcggcttgccaacattcgccacatgcaatggtggtcctgctgagatcattgtgcacggcaagtctggcttccacattgacccttaccatggtgaccgtgctgctgatctccttgttgacttctttgagaagtgcangcttganccaactcac

SEQ ID NO: 2586 - DNA, 415 bp, Glycine max
  unsure (1)..(415): unsure at all n locations
gttcgtgccttggagaatgagatgctcaaccgcatcaagaagcaaggccttgatatcacccctcgtattctcattattactcgtcttctccctgatgcagtaggaactacctgtggccaacgtctagagagggtatatgatactgaatattgtgacattctccgagttcctttcagaaccgaaaagggaattgttcgcaaatggatctcaagattcgaagtctggccatacctagagacttacactgaggatgttgcccttgaacttgccaaggagttgcaagccaagccagatctgatcgttggaaactacagtgatggaaacattgttgcctctttgttagcacatanattaggagtaactcagtgtaccattgctcatgctctagaaaagaccaagtaccctgagtctgaca

SEQ ID NO: 2587 - DNA, 403 bp, Glycine max
gaaatatcatttctcatgccaatttactgctgatctttttgcaatgaaccacacagactttatcatcaccagcaccttccaagagattgctggaagcaaggacactgttggacagtatgagagtcacactgccttcacccttccaggactttaccgtgttgttcacggtattgatccatttgatccaaagttcaacattgtctctcccggtgcagacatgggtatatacttcccatacactgaaactgagcgtaggttaacagaattccactctgacattgaagagcttctttacagctcagtggagaatgaggaacacatatgcgtattgaaggaccgcaacaaaccaataatcttcaccatggcaaggcttgaccgtgtgaagaacaacacggggcttgtc

SEQ ID NO: 2588 - DNA, 417 bp, Glycine max
acgtacggctgcgagaagacgacagaaggggatggaaacattgttgcctctttgttagcacataaattaggagtaactcagtgtaccattgctcatgctctagaaaagaccaagtaccctgagtctgacatttactggaaaaaatttgaagagaaatatcacttctcatgccaatttactgctgatctttttgcaatgaaccacacagactttatcatcaccagcaccttccaagagattgctggaagcaaggacactgttggacagtatgagagtcacactgccttcacccttccaggactctaccgtgttgttcacggtattgatccctttgatccaaagttcaacatcgtctcttccggttgccgacatgagcataaacttcgcatacactgaaactgagcgtaggttaacaga

SEQ ID NO: 2589 - DNA, 455 bp, Glycine max
caggtacacgtggaagatttattccgaaaggcttatgactttggcgggagtttatagtttctggaaatgcgtttccaaattagagaggcgtgaaactcgacgatatcttgagatgttctatatcctcaagttccgtgatttggcaaattctgttccgctagctaaggatgatgcaagttaactagctatataatttcaccaaaggcttgacagcagacataataagagtcatttatgtaaatataatagtctgcttctcgtgttttgaaatctagtgaggcgacctagaggagtttcatggaagacttgtcttgtctatgttaacttcgattatgtaagagatggcgagcactggttgttgaatttggatgtctcttgttttcgtttgattagtagtcatcaatgatatagacctggaaattacctgtgacttgaggatgttatccttactgatg

SEQ ID NO: 2590 - DNA, 381 bp, Glycine max
gttcattctgttttccagttgaagtctttccctagccaatggccactgatcgtttgacccgggttcacagtctccgtgagaggcttgatgaaaccctcactgccaacaggaacgaaattttggcccttctgtcaaggatcgaagctaagggcaaggggatcctgcaacaccaccaggtcattgctgagtttgaggaaatccctgaggagaacaggcagaagcttactgatggtgcctttggagaagtcttgagatctacacaggaagccatagttttgccaccatgggttgctctggctgttcgtccaaggcctggtgtgtgggagtacctgaaagtgaatgtgcacgctcttgttgttgaggagttgcaacctgctgagt

SEQ ID NO: 2591 - DNA, 276 bp, Glycine max
  unsure (1)..(276): unsure at all n locations
gttgatgctattatcaagtgtcaaggtcttcctacaacatcaggatacatggttgtaaatatggaatggggaaacttttggtcatctcatttaccaagaacatcttatgatattgatttagactctgaaagccctaatccaaatgatcagggttttgagaaaatgatatctggaatgtatcttggtgacatcgtgaggagagtcatnctaaggatgncgctagagncnntntnnctngnnccnattcttccaaactttcaagccnntatgctgagg

SEQ ID NO: 2592 - DNA, 153 bp, Glycine max
gttgaagaagccctactctctcgacgcctctttcctctccgacatcgagaacgaccccttcgagaacctgcaagagactcacgatatcttcgtcaaccagatgggtatcaagcccattgggcttaagttagagtttccggggggttttcgaaa

SEQ ID NO: 2593 - DNA, 223 bp, Glycine max
ccgggcttcccatgatacccagctatgttgaaaatcttcccactgggaatgagaaagggttgttttatgccttggatctcggaggaaccaacttccgtgtgctgagggtgcagttgggtggcaaagatgagcgtgtcattgccaccgagtttgatcaagtttccatacctcatcaactcatgtttgctacatctcaggagctgtttgatttcattgcttcggg

SEQ ID NO: 2594 - DNA, 257 bp, Glycine max
tgcacgcgggtcttgcttctgaaggtggcagcaagctcaagatgttgatcacttatgttgataatctcccttctggggatgagaaaggactcttttatgcattagaccttggtggcacaaacttccgaacccttcgcgtgcatttaggtgggaaggagaaaggtgttgtcaaaatagagtctgatgaagtttccattcctcctcatttgatgactggttcttcacaagaattatttgattttatagcatctaaacta

SEQ ID NO: 2595 - DNA, 246 bp, Glycine max
atttgatgactggttcttcacaagaattatttgattttatagcatctaaactagcaaaattcgttagttctgagcctgaagagttacaccctccccctggcagacaaagggaattgggttttaccttctcatttccagtgaggcaaacatcaattgcatctgggaatataataaagtggactaaaggtttcaatcttgaggatgcggttggagaagatgtggtgggtgaactgaccaagtccttag

SEQ ID NO: 2596 - DNA, 262 bp, Glycine max
gcagattctacaatcaggatgtcattgctgctgtgattcttggtactgggacaaatgcagcatatgtagaacgagcacatgctattccaaaatggcatgggcttataccaaaatcaggagatatggttataaacatggagtggggtatttccgatcatcacatcttcctctaacagaatatgatctagctccggatgctcagagcttaaaccctggagaacagatttttgagaaattgatttctggcatgtatttgggggaa

SEQ ID NO: 2597 - DNA, 254 bp, Glycine max
atcggttgggaggctgaggcaggtggtggatgctatggccgttgagatgcacgctgggttggcatcagaaggtggttccaagctcaaaatgcttctcacatatgttcataatctccctaatgggactgagaaaggaacatattatgcactagatcttgggggtactaattttcgggttttgcgggttcatttgcatggtcaacaatcttctgttttggaacatgaagtagagcgacacccattcctcaaaatct

SEQ ID NO: 2598 - DNA, 267 bp, Glycine max
  unsure (1)..(267): unsure at all n locations
ctcccatcagaggacaaagcttccgactttgcgggattcgttcgtatttgtttcagtgctgtgatggggaaggtcgcggtgggagctgccgttgtctgcgccgccgccgtatgcgctgcggcggcgctggtggtgcgccaccgcatgattcgttcccggaagtggagtcgcgccatggcgatactgaaggagtttgaggagaagtgtggcaccccaattgtgaagctaagacaagtgcgctgatgccatggatnttgagatcacgcg

SEQ ID NO: 2599 - DNA, 252 bp, Glycine max
gttacaccctccccctggcagacaaagggaactgggttttacattctcatttccagtgaagcaaacatccatagcatctgggactctaataaagtggactaaaggtttcaatattgaggatgcggttggagaagatgtggtgggtggactaaccaagtccttagaaaaaattggtctggatatgcgtgttgcagctctagttaatgacacagttggaactgtggctagagctagattcagcaatcaggatgt

SEQ ID NO: 2600 - DNA, 250 bp, Glycine max
tgaagatgcggttggtgaagatgtggtgggagaactaaccaagtccatggaaaaaattggcctggatatgcgcgttgctgctctagtcagtctcactctcctctcttttggatttctttattttttatagccggatttgagcatgatggtttccagtttgtgtctgacagaaatttggagttataaggttaatgataccattggaacattagctggaggcagattctacaatcaggatgtcattgctgct

SEQ ID NO: 2601 - DNA, 252 bp, Glycine max
  unsure (1)..(252): unsure at all n locations
gatatattagagatcaataacacatccctgaaaatgaggaagattgttgtggaactctgtgatattgttgctaatcggggagcccgcctttctgctgctggtatttttggcatcctcaagaaaataggaagagacacagtaaaggacgggaagaaatcagtagtagcactggatggaggattgtttgaacactatactaattcagagttccttggagagtacaaaaaggtttttgggnaacncccccnacca

SEQ ID NO: 2602 - DNA, 268 bp, Glycine max
cgataatctcccaactggggatgaggaaggcctctattatgcattggatcttggcggcacaaacttccgtgtccttcgtgtacatttaggggggaaagacaaaggtgttatcggccaggagtttgaagaagtttcaattcctccaaatttgatgactggctcttcagatgcattgttcgattttatagcagcaggtcctgcaaagtttgttgggtcagaaccctgaaggtttcatctccccctgggaagacaagaggactgggtttac

SEQ ID NO: 2603 - DNA, 268 bp, Glycine max
attttgggcatccttaagaaaataggaagagacacggttaaggttggggagaagcaaaagtcagtgatagctttggatgggggattgtttgaacactacaccaaatttagagaatgcttggagggtaccctgaaggaattgctgggagatgaggctgctgagaccattgtcattgagcatgctaatgatggctctggcattggtgcagccctcctggcagcttctcactcccaatatttgggagtggaggagtcttaaattttattgc

SEQ ID NO: 2604 - DNA, 224 bp, Glycine max
ctcaaacacatcccttaaaatgaggaagatcgttgttgaactgtgtgacattgttgctactcgcggagctcggcttgctgctgctggtattttgggcatccttaagaaaataggaagagacacagttaaggttggggagaagcaaaagtcagtgatagcgttggatggggggttgtttgaacactacaccaaatttagagaatgcttggagagtgcactgaagg

SEQ ID NO: 2605 - DNA, 265 bp, Glycine max
cgatctgcacgctgggttggcatcagaaggtggttctaaactcaaaatgcttataacatttgttcataatctccctaatgggactgagaaaggaacatattatgcactagatcttgggggtacaaattttagggttttgcgggttcatttgcatggtcaacaatcgtctgttttggaacatgaagtagagcgacagcccattcctcaacatctaatgaccagcacaagtgaggatctctttgatttccttgcttcttcattaaag

SEQ ID NO: 2606 - DNA, 266 bp, Glycine max
  unsure (1)..(266): unsure at all n locations
accaagtccatggaaaaaattggcctggatatgcgcgttgctgctctagttaatgataccattggaacattagctggaggcagattctacaatcaggatgtcgttgctgctgtgattcttggtactgggacaaatgcagcatatgtagaacgtgcacatgctattccaaaatggcatggccttataccnnaatcaggagatatggttataaacatggagtggggtaatttccgatcatcacatcttcctctaacagaatatgatct

SEQ ID NO: 2607 - DNA, 261 bp, Glycine max
gtttggaaaatctgtcccgcagacactatctacacctttcatactcgggacctcagatctatgtgccatgcaacaggactgttctggcgatttacatgcagttgggtctctcctctacgataaagcaggggttgaatccaatttaagtgaaagagaaacagttttggaggtttgtgagactattgtaaagcgaggcgggagcttagctggtgcaggaatagtggggattctacaaaaaatggaagaggaccagagaggtct

SEQ ID NO: 2608 - DNA, 268 bp, Glycine max
tctcgagccgctcgagccgcggctcgagaattgttagacgagtgcacgctggaaatggctgaagacggtgacctgtttggaaaatctatcccgcagacactatctacacctttcatactcgggacctcagatctatgtgccatgcaacaggactgttctggcgatttacatgcagttgggtctctcctctacgataaagcaggggttgaatccaatttaagtgaaagagaaacagttttggaggtttgtgagactattgtaaagcgag

SEQ ID NO: 2609 - DNA, 261 bp, Glycine max
caagaaaataggaagagacacagtaaaggacgggaagaaatcagtagtagcactggatggaggattgtttgaacactatactaaattcagaagttccttggagagtacactaaaggagttgttgggagatgaggcagctgagacaattggcattgagcagtctaatgatggctctggaattggagcagccctcctggcagcttctcactcccagtatttggaagtgcaggagtcctgaagatgtggttaatgtcaaggtaa

SEQ ID NO: 2610 - DNA, 264 bp, Glycine max
  unsure (1)..(264): unsure at all n locations
cgggnagaaatcagtagtagcacngcatggnggattgnnccnacactatactnncattcagaagttccttggagagtacactaaaggagttgttgggcntgaggcagctgngacaattggcattgagcagtntaatgatggctncggaattggagcagccctcctggcagcttctcactcccagtatttggaagtgcaggagtcctgaagatgtggtttaatgncanggtaaatcagtgtaacatagtttcattttttgatacc

SEQ ID NO: 2611 - DNA, 247 bp, Glycine max
cccaaattgaaagttcctttcatacttaggacgcctgacatgtcagccatgcaccatgacacaagttctgatctgaaagtggttggaaacaagttaaaggatatattagagatctcaaacacatccttaaaatgaggaagatcgttgttgaactgtgtgacattgttgctactcgcggagctcggcttgctgctgctggtattttgggcatccttaagaaaataggaagagacacagttaaggttgg

SEQ ID NO: 2612 - DNA, 247 bp, Glycine max
gaagttgtaaggagagctttattgaagatggccgaagaagctgacttttttggcgatactgtgccccccaaattgaaagttcctttcatacttaggacgcctgacatgtcagccatgcaccatgacacaagttctgatctgcaagtggttggaaacaagttaaaggatatattagagatctcaaacacatcccttaaaatgaggacgatcgttgttgaactgtgtgacattgttgctactcgcggag

SEQ ID NO: 2613 - DNA, 278 bp, Glycine max
cggctcgagttcacagatttttgagaaattgatttctggcatgtatttgggggaaattgtaaggagagctttatttaagatggccgaagaagctgatttttttggagatactgttccccccaaattgaaagttcctttcatacttaggacgcctgacatgtcagccatgcaccatgacacaagttctgatctgaaagtagttggaaacaaattaaaggatatattagagatctctaacacatccctaaaaatgaggaagattgttgttgaactgtgtg

SEQ ID NO: 2614 - DNA, 249 bp, Glycine max
tgcccaaaataccagcagcagcaagccgagctccgcgagtagcaacaatgtcacacagttcaacaacgatcttcctcattttaagggatgtgtttgagatctctaatatatcctttaacttgtttccaaccactttcagatcagaacttgtgtcatggtgcatggctgacatgtccaggcgtcctaaagaaaattatgtcagaactccaaaagctctatttcaacaaaaggtaatgtgttcaaatgaag

SEQ ID NO: 2615 - DNA, 255 bp, Glycine max
ggtcgcgtggtggctattgtgaaagagtttgaggagcagtgtaggaccccaattgggaagctgagacaggttgctgacgccatggacgttgagatgcacgcgggtcttgcttctgaaggtggcagcaagctcaagatgttgatcacttatgttgataatctcccttctggggatgagaaaggactcttttatgcattagaccttggtggcacaaacttccgaacccttcgcgtgcatttaggtgggaaggagaaa

SEQ ID NO: 2616 - DNA, 248 bp, Glycine max
gcggcggcgtgtgctgcggtggcgctggtggtgcgcaccgatgatgagctccggaaagtggggtcgcgtggtggctattgtgaaagagtttgaggagcagtgtaggaccccaactgggaagctgagacaggttgctgacgccatggacgttgagatgcacgcgggtcttgcttctgaaggtggcagcaagctcaagatgttgatcacttatgttgataatctcccttctggggatgagaaaggatctt

SEQ ID NO: 2617 - DNA, 263 bp, Glycine max
  unsure (1)..(263): unsure at all n locations
atgaggagctccggaaagtggggtcgcgtggtggctattgtgaaagagtttgaggagcagtgtaggaccccaattgggaagctgagacaggttgctgacgccatggacgttgagatgcacgcgggtactgcttctgaaggtggcagcaagctcaagatgttgatcacttatgttgataatctccctctggggatgagaaaggactctttatgcnttagacctggtggcacaaacttccgaaccctcgctgcattagtgggaag

SEQ ID NO: 2618 - DNA, 143 bp, Glycine max
cagtgttggaccccaatttcgaagctgagacaggttgctgatgccctggacgttgagatgcacgctggtcttgcttctgaaggtggatgtaagctcaagatgttgatcacttatgttgataatctcccttctggggatgagaa

SEQ ID NO: 2619 - DNA, 279 bp, Glycine max
  unsure (1)..(279): unsure at all n locations
cggtcgtttgcncggcggcggcgtgtgctcncngtggcgctggtggtgcgccancgcatgangagctccggaaagtggggtcgcgtggtggctattgtgaaacagtttgaggagcagtgtaggaccccaattgggaagctacgacagttgctgacgccatggacgttgagatgcacgcgggtcttgcttctgaaggtggcagcaagctcaagatgttgatcacttatgttgataatctcccttctggggatgagaaaggactcttttatgcattagacc

SEQ ID NO: 2620 - DNA, 289 bp, Glycine max
  unsure (1)..(289): unsure at all n locations
catcaattgcatctgggaatataataaagtggactaaaggtttcaatattgaggatgcggttngagaaagatgtngtgggtgaactgnccaagtccttagnaaaaattggtctggatatgcatgttgcagctctagttaatgacacagttggaacagtggctagagcaagattcagcaatcaggatgtcattgctggantgantcttggtactgggacaaatgcagcttatgtagagtgtgcacatgcaattccacaatggcatggtcttctaccaaaatcaggagacc

SEQ ID NO: 2621 - DNA, 264 bp, Glycine max
actcgagccgattcggctcgagtgaggatgcggttggagaagatgtactgggtggactaaccacagtcttagaaaaaattggtctggatatgcgtgttgcagctctagttaatgacacagttggaactgtggctagagctagattcagcaatcaggatgtcattgctggagtgattcttggtacagggacaaatgcagcttatgtagagtgtgcacatgcaattccaaaatggcaaggtcttctaccaaaatcaggagagatgg

SEQ ID NO: 2622 - DNA, 270 bp, Glycine max
gagaacagatttttgagaagataatttctggtatgtatttgggtgaaattgtaaggagagttttgttgaagttggctgaagaagttgacttctttggagatactgttcctccaaaattgagaattcctttcgtacttaggacacctgacatgtctgcaatacatcaagatacatcttcagatctgaaggtggttggaaacaaattgaaggatatattagagatcaataacacatccctgaaaatgaggaagattgttgtggaactctgtg

SEQ ID NO: 2623 - DNA, 273 bp, Glycine max
atttctggtatgtatttgggtgaaattgtaaggagagttttgttgaagttggctgaagaagttgacttctttggagatactgttcctccaaaattgagaattcctttcgtacttaggacacctgacatgtctgcaatacatcaagatacatcttcagatctgaaggtggttggaaacaaattgaaggatatattagagatcaataacacatccctgaaaatgaggaagattgttgtggaactctgtgatattgttgctaatcggggagcccgc

SEQ ID NO: 2624 - DNA, 267 bp, Glycine max
cagagaggtctcgtctttgggaatgggaagagaagtgttgttgccattgatgggggcttatatgaaaattatcctcaatacagggcttatttgcaagattcagtcacagagctgctaggaacagaaaagtcaaacaatgtggtgatagagcatactaaagatggatctggaataggagctgctctattggctgcttcaaactccatgtacaaccaagacttatagtccattatcatgcaaataaaaattgaaggaataatccatttt

SEQ ID NO: 2625 - DNA, 280 bp, Glycine max
cagagaggtctcgtctttgggaatgggaagagaagtgttgttgccattgatgggggcttatatgaaaattatcctcaatacagggcttatttgcaagattcagtcacagagctgctaggaacagaaaagtcaaacaatgtggtgatagagcatactaaagatggatctggaataggagctgctctattggctgcttcaaactccatgtacaaccaagacttatagtccattatcatgcaaataaaaattgaaggaataatccatttttccttttgtatat

SEQ ID NO: 2626 - DNA, 248 bp, Glycine max
ttgaaaacaagtccacagtacttttttatggtggtggggctttagttgctgtttggctatcgtcgattcttgtgagcgccatcaactctgttcccttgcttccaaagattatggagttggtggggctagggtacactggatggtttgtctaccgataccttctgtttaagtctagcaggaaggagctagctacagacattgagtcactgaagaagaaaattactggaactgaatagagtggtgttagc

SEQ ID NO: 2627 - DNA, 234 bp, Glycine max
cttatcttccctcaaccacttctcagtgtcccgaaaatcttctcaccttcagaccagagcttcttcagaggaatcatcctcagtagatgccaatgaggtgttcacagatttgaaggaaaagtgggatgctcttgaaaacaagtccacagtacttttttatggtggtggggctttagttgctgtgtggctatcgtcgattcttgtgagcgccatcaactctgttcccttgcttcc

SEQ ID NO: 2628 - DNA, 430 bp, Glycine max
aatgacacagttggaacagtggctagagcaagattcagcaatcaggatgtcattgctggagtgatccttggtacggggacaaatgcaccttatgtagagtgtgcacatgcaattccaaaatggcatggtcttctaccaaaatcaggagagatggttattaacatggagtggggtaatttccgttcctcgcatcttcctctaacagaatatgatcatgctctagatgcagagagcttaaaccctggagaacagatttttgagaagataatttctggtatgtatttgggtgaaattgtaaggagagttttgttgaagttggctgaagaagttgacttctttggagatactgttcctccaaaattgagaattcctttcgtacttaggacacctgacatgtctgcaatacatcaagatacatcttcagatctga

SEQ ID NO: 2629 - DNA, 413 bp, Glycine max
  unsure (1)..(413): unsure at all n locations
agcccacgcgtccgtacggctgcgagaagacgacagaaggggttggatggggggttgtttgaacactacaccaaatttagagaatgcttggagagtgcactgaaggaattgctgggagatgaggctgctgagaccattgtcattgagcatgctaatgatggctctggcattggtgcagccctcctggcagcttctcactcccaatatttgggagtggaggagtcttaaattttattgccaaacaagggaaagacgtgtaatactagtttcattttttgcataggtggtagatcaacacattgaagcaatggtgccttgcagctggtgactgggggggcattcattattttggtttcagtgtntgtttctccctcgtttaagggaatatatcaaagatataaacttcaccttga

SEQ ID NO: 2630 - DNA, 402 bp, Glycine max
tgctaatcggggagcccgcctttctgctgctggtatttttggcatcctcaagaaaataggaagagacacagtaaaggacgggaagaaatcagtagtagcactggatggaggattgtttgaacactatactaaattcagaagttccttggagagtacactaaaggagttgttgggagatgaggcagctgagacaattggcattgagcagtctaatgatggctctggaattggagcagccctcctggcagcttctcactcccagtatttggaagtgcaggagtcctgaagatgtggtttaatgtcaaggtaaatcagtgtaacactagtttcatttttttgtatacctactagatcaacagattgaaacagaaaagtcttcgttactagtcctagagagctttt

SEQ ID NO: 2631 - DNA, 445 bp, Glycine max
gtccgtaaagctgcgagaagacgacagaaagggacatcacattttctcaaagtaatttattacttactaaataaatggcggcggcagcagcagtgacggtgctactctcatctatgattccgaccgccaccaacgttacacgctgctctgctttgccttctctgcctcctcgcggcatcaacactaaaaccactttgctcttatcttccctcaaccacttctcagtgtcccgaaaatcttctctgcttcagaccagagcttcttcagaggaatcatcctcagtagatgccaatgaggtgttcacagatttgaaggaaaagtgggatgctcttgaaaacaagtccacagtacttttttatggtggtggggctttaattgctgtttggctatcgtcgattcgtgtgagcgccatcaactctgttcccttgcttccaaagattatgga

SEQ ID NO: 2632 - DNA, 400 bp, Glycine max
ggggatagatagagtgatacgcgtcacgttttcataataataaaaaaatggcagcggcggcggcagtgacggtgctactcccacctaggattccgaccaccaccaacgttacccgctgctctgctttgccttctctccctcctcgcgtctccaacaccaaaaccactttgttctcaccttccctcaacaacttttcagtgtcccgaaaatcttctctgcttcagaccatagcttcttcagaggaatcatcctcagtagatgccaatgaggtgttcacagatttgaaggaaaagtgggatgctcttgaaaacaagtccacagtacttctttatggtggaagggctatagttgctatttggctatcgtcaattcttgtgagcgccatcaactcagttccctt

SEQ ID NO: 2633 - DNA, 413 bp, Glycine max
gatagatagagtgatacacatcacattttctcaaagtaagttattaattaataaataaatggcggcggcggcggcagtgacggtgctactcccacctaggattccgaccgccaccaacgttacccgctgctctgctttgccttctctgcctcctcgcggcaccaacactaaaaccactttgctcttatcttgcctcaaccacttctcagtgtcccgaaaatcttctctgcttcagaccagagcttcttcagaggaatcatcctcagtagatgccaatgaggtgttcacagatttgaaggaaaagtgggatgctcttgaaaacaagtccacagtacttttttatggtggtggggctttagttgctgtttggctatcgtcgattcttgtgagcgccatcaactctggtcccttgc

SEQ ID NO: 2634 - DNA, 406 bp, Glycine max
aaagttccaaattttttggtttggggatagatagagtggtacgcgtcacattttcataataataaaaaaatggcagcggcggcggcagtgacggtgctactcccacctaggattccgaccaccaccaacgttacccgctgctctgctttgccttctctccctcctcgcgtctccaacaccaaaaccactttgttctcaccttccctcaacaacttttcagtgtcccgaaaatcttctctgcttcagaccagagcttcttcagaggaatcatcctcagtagatgccaatgaggtgttcacagatttgaaggaaaagtgggatgctcttgaaaacaagtccacagtacttctttatggtggaggggctatagttgctatttggctatcgtcaattcttgtgagcgcca

SEQ ID NO: 2635 - DNA, 246 bp, Glycine max
cggctcgagcttctacagcattcttctgctattcaaatcaaattttcaaaccatggcttcctccaccaatgatatactacgaaaaggcaacggtatatacgtgagcttcggcgagatgctcatcgatttcgtccccaccgtctccggcgtgtcccttgcggaggctcgggctttcttcaaggcccccggcgtcggcccccgccaacgtcgccatcgccgtcgcgaggctcggcggaaaggcggcgt

SEQ ID NO: 2636 - DNA, 259 bp, Glycine max
gccatgcagatcagcacacctgaaggcaatggaagttgccagggaagcaggatgcttgctctcttatgacccaaacctgcggctacccttgtggccctccgccgaggaagcacgtcagcaaatactcagcatatgggacaaggctgatgtaatcaaggtcagtgatgtggaactggaattcctaaccggaagtgacaaaattgatgatgcatctgctctctccctgtggcaccccaatttgaagttgctccttgtcact

SEQ ID NO: 2637 - DNA, 294 bp, Glycine max
  unsure (1)..(294): unsure at all n locations
aaaggtcagtgatgtggagnttgatcaaatcancnnttctnccaaatgctgagtatttgcttacgagcttcctcagcatttggnagaaggctganttgacannaggtcagtgatgtggagcttgagttcctcaccggaagtgacaagattgatgatgaatctgctttgtcattgtcacnccccaatttgaagttgctccttgtcactcttggagaacatggttccagatactacaccgagaatttcaaaggatcagtagatgcttttcatgttaatacagttgatacaactggt

SEQ ID NO: 2638 - DNA, 295 bp, Glycine max
  unsure (1)..(295): unsure at all n locations
cgccgacggagagcgtgagttcatgttctacagaaaccccagcgccgacatgctgcctcaccgcccgaagatctcaatctncgaactcatcagatctggcaaaagtattcccattatggatcgataagcttgatacgtggagccatgcagattcaggcaacaccctgaagggcaatggaagttggccagggaaggcaggcatggcttgctcctcttatgcancccaaaacctgncgngctaaaccttgtgggccctnccggccgagcgacggcacgtncagcccaataccncnnc

SEQ ID NO: 2639 - DNA, 266 bp, Glycine max
ccaagattgtcgatgatcagtccatacttgaagatgaaccaaggttaagagaagtactaaagtttgcaaatgcatgtggagctattacaactacccaaaagggagcaattccggcccttcccaaagaggaggctgcactgaaactgatcaaaggggggtcacagaatcttttggcaaaatgcaaaagtgctagcatgatttcgttttcttcccctaatgtttaaattttccgttggatttgcttgctataagtttaggagggaact

SEQ ID NO: 2640 - DNA, 205 bp, Glycine max
  unsure (1)..(205): unsure at all n locations
gtgagttcttgtttttccgaaatcctagtgctgatatgctacttcaagagtccgagcttgataaaaatctcataaagaaggctaaaattttccattatggttccatcagcttgattgatgagccatgcaagtctgctcatcttgctgctatgagatttgctanagaatctggttgcattctttcgtatgatccaaatttgagatt

SEQ ID NO: 2641 - DNA, 286 bp, Glycine max
cggacttcggctcgaggctcatcgacttcgtccccaccgtctctggcgtgtccctggccgaggcccctggcttcctcaaggcccccggcggcgcccccgctaacgtcgccatcgccgtgtcgcgcctcggcggcaaagccgccttcgtcggcaagctcggcgacgacgagttcggccacatgctcgccggaatcctcaaggaaaacggcgttcgcgccgacggcatcaactttgaccagggcgcacgcaccgccctggccttcgtgaccctacgcgccgacgggga

SEQ ID NO: 2642 - DNA, 268 bp, Glycine max
cttctatctctgcaattcaaacacaaaaaccatggcttccactaatgctcttcctcccaccggcaacggcctcatcgtgagcttcggcgagatgctcatcgacttcgttcccaccgtctccggcgtgtccctcgcggaggctccgggattcctcaaggcccccggcggcgcccccgccaacgttgccatcgccgtcgcgagactcggtcgcaaagcggcgttcgtcgggaagctcggcgacgacgagttcgggcacatgctggccgga

SEQ ID NO: 2643 - DNA, 265 bp, Glycine max
cggctcgagccggcgtgtccctcgcggaggctccgggattcctcaaggcccccggcggcgccccccgcaacgttgccatcgccgtcgcgagactcggcgccaaagcggcgttcgtcgggaagctcggcgacgacgagttcgggcacatgctggcccgaatcctgaaggagaacgacgtgcgatccgacgggatcaacttcgaaaagggcgcgcgcaccgcgctggcgttcgtgaccctacgcgccgacggggagcgtgagttcat

SEQ ID NO: 2644 - DNA, 263 bp, Glycine max
ccaacgctcttcctcccaccggcaacagcctcatcgtgagcttcggcgagatgctcatcgatttcgtccccaccgtctccggcgtgtcccttgcggaggctccgggcttcctcaaggcccccggcggcgcccccgcaacgtcgccatcgccgtcgcgaggctcggcggaaaggcggcgttcgtcggaaagctcggcgacgacgagttcgggcacatgctggctgagatcctgaaggagaacgacgtgcgatacgacgggatca

SEQ ID NO: 2645 - DNA, 247 bp, Glycine max
ctcgagccgttctatctctgcaattcaaacacaaaaaccatggcttccactaatgctcttcctcccaccggcaacggcctcatcgtgagcttcggcgagatgctcatcgacttcgttcccaccgtctccggcgtgtccctcgcggaggctccgggattcctcaaggcccccggcggcgcccccgccaacgttgccatcgccgtcgcgagactcggcggcaaagcggcgttcgtcgggaagctcggcg

SEQ ID NO: 2646 - DNA, 276 bp, Glycine max
  unsure (1)..(276): unsure at all n locations
actaactctctcatcttctacagcattcttctgcaattcaaatcaaattttcaaaccatggcttcctccaccaacgctcttcctcccaccggcaacggcctcatcgtgagcttcggcgcgatgctcatcgatttcgtccccaccgtctccggngtgtcccttgcggaggctccgggcttcntcaaggcccccggcggcgcncccgccaacgtcgncatcgccgtcgcgaggctcgncggaaaggcggcgttcgtcggnaagtcggngacgacgagt

SEQ ID NO: 2647 - DNA, 299 bp, Glycine max
tacagcattcttctgcaattcaaatcaaattttcaaaccatggcttcctccaccaacgctcttcctcccaccggcaacggcctcatcgtgagcttcggcgagatgctcatcgatttcgtccccaccgtctccggcgtgtcccttgcggaggctccgggcttcctcaaggcccccggcggcgcccccgccaacgtcgccatcgccgtcgcgaggctcggcggaaaggcggcgttcgtcggaaagctcggcgacgacgagttcgggcacatgctggctggaacctgaaggagaacgacgtc

SEQ ID NO: 2648 - DNA, 277 bp, Glycine max
ctcgagccgctcgtagcatttcggcatccaaactaactctctcatcttctacagcattcttctgcaattcaaatcaaattttcaaaccatggcttcctccaccaacgctcttcctcccaccggcaacggcctcatcgtgagcttcggcgagatgctcatcgatttcgtccccaccgtctccggcgtgtcccttgcggaggctccgggcttcctcaaggcccccggcggcgcccccgccaacgtcgccatcgccgtcgcgaggctcggcggaaaggcg

SEQ ID NO: 2649 - DNA, 279 bp, Glycine max
acggctggcgagaagacgacagaaggggggagaaggctgatttgatcaaggtcagtgatgcggagcttgagttcctcacaggaagtgacaagattgatgatgaatctgctttgtcattgtggcaccccaatttgaagttgctccttgtcactcttggggaacatggttccagatactacaccaagagtttcaaaggatcggtagatgctttccatgtcaatacagttgatacaactggtgccggtgattcctttgttggtgctttattggccaagattg

SEQ ID NO: 2650 - DNA, 265 bp, Glycine max
gatcaaggtcagtgatgcggagcttgagttcctcacaggaagtgacaagattgatgatgaatctgctttgtcattgtggcaccccaatttgaagttgctccttgtcactcttggggaacatggttccagatactacaccaagagtttcaaaggatcggtagatgctttccatgtcaatacagttgatacaactggtgccggtgattcctttgttggtgctttattgccaagattgtcgatgatcagtccatacttgaagatgaac

SEQ ID NO: 2651 - DNA, 230 bp, Glycine max
tgagcatttgggagaaggctgatttgatcaaggtcagtgatgcggacttgagttcctcacaggaagtgacaagattgatgatgaatctgctttgtcattgtggcaccccaatttgaagttgctccttgtcactcttggggaacatggttccagatactacaccaagagtttcaaaggatcggtagatgcttgccatgcaatacagttgatacaactggtgcccggtgatc

SEQ ID NO: 2652 - DNA, 241 bp, Glycine max
attattttcaggctagaatattccattatggctccatcagcttgattgatgagccatgcaagtcagctcaccttgctgctatgagcattgccaaaaactctggttgcattctatcatatgatccaaatttgagattggctctatggccttctgcagacgccgctcggaaaggcataatggatatatgggatcaagctgatgtcataaagataagtgaggatgagattacatttttgactgg

SEQ ID NO: 2653 - DNA, 262 bp, Glycine max
ctccatcagcttgattgatgagccatgcaagtcagctcaccttcctgctatgagcattgccaaaaacctggttgcattctatcatatgatccaaatttgagattggctctatggccttctgcagactccgctcggaaaggcataatggatatatgggatcaagctgatgttataaagataagtgaggatgagattacatttttgactgggggtgatgatccttatgatgataatgttgttttgaagaaactttttcacccaa

SEQ ID NO: 2654 - DNA, 273 bp, Glycine max
attctcttacccgtataaactactattaacttccaccagaacacgtttctggtttcttctggctctgcatttaccatactctgtttcttggtttcaattcaatcacacacctctttgccctcatggcccactttacctcctcaggtaaatcagacaatctcaccatagaagactgtattggaaaaagtgcgctggttgtgtgctttggtgaaattttaatagactttgtgccaacagtgtgtggagtgtcactagctgaagcacctgctttca

SEQ ID NO: 2655 - DNA, 272 bp, Glycine max
  unsure (1)..(272): unsure at all n locations
caagctgatgttataaagataagtgaggatgagattacatttttgactgggggtgatgatccttatgatgataatgttgttttgaagaaactttttcacccaaatctcaagcttttaattgttactgaaggttcacagggttgcagatattacacgaaggcatttaagggcagggttgcaggtgttaaagttaaacctgtagacacaactggagctggcgatgcatttgttagtgggattttatactgcatagcttctgaccanactatttt

SEQ ID NO: 2656 - DNA, 128 bp, Glycine max
gtacagataagtgaggatgagattacatttttgactgggggtgatgatccttatgatgataatgttgttttgaagaaactttttcacccaaatctcaagcttttaattgtaactgaaggttcacaggg

SEQ ID NO: 2657 - DNA, 239 bp, Glycine max
ctcttcattacacaacaacaaagtagttgttaatagcctctgttttcttcttgccaccaaaatctcacaccttccattgcatcatcattcataaatggctcatcccacctcatcaggtcaatcccatgatctcaaaaaagaagattgcaaggaaacaagatcactggttgtttgctttggggaaatgttaatagactttgttccaacggtgggaggagtgtcactggctgaagcacccg

SEQ ID NO: 2658 - DNA, 229 bp, Glycine max
tgttgacaattctggcctgctctttgatgatcatgcaaggacagcgttgggattttatgctcttaagagtaatggagaacctgaattcatgttttaccgaaatccaagttctgatgtgctccttcgtcctgatgaaattgatatggacctcataaagaaggccacaatatttcattatggttcaaagtttgattaaggaacctgtaggtcagctcatcttgctgcaatg

SEQ ID NO: 2659 - DNA, 256 bp, Glycine max
ctcttggggaacatggttccagatactacaccaagagtttcaaaggatcggtagatgctttccatgtcaatacagttgatacaactggtgccggtgattcctttgttggtgctttattggccaagattgtcgatgatcagtccatacttgaagatgaaccaaggttaagagaagtactaatgtttgcaaatgcatgtggagctattacaactacccaaaagggagcaattccggcccttcccaaagaggaggctgc

SEQ ID NO: 2660 - DNA, 266 bp, Glycine max
ctgtcactcttggggaacatggttccagatactacaccaagagtttcaaaggatcggtagatgctttccatgtcaatacagttgatacaactggtgccggtgactcctttgttggtgctttattggccaagattgtcgatgatcagtccatacttgaagatgaaccaaggttaagagaagtactaaagtttgcaaatgcatgtggagctattacaactacccaaaagggagcaattccggcccttcccaaagaggaggctgcactg

SEQ ID NO: 2661 - DNA, 234 bp, Glycine max
tctcgagccgattcggctgagatggttccagatactacaccaacagtttcaaaggatcggtagatgctttccatgtcaatacagttgatacaactggtgccggtgattcctttgttggtgctttattggccaagattgtcgatgatcagtccatacttgaagatgaaccaaggttaagagaagtataaagtttgcaaatgcatgtggagctattacaactacccaaaagggagc

SEQ ID NO: 2662 - DNA, 253 bp, Glycine max
  unsure (1)..(253): unsure at all n locations
cgaaaacagtgttccaaaatccacacacactctctctcntcatggcgttgaacaatggcgtccccgccaccggcaccggcctcatcgtcagcttcggtgagatgctcatcgacttcgtccccaccgtctctggcgtgtccctggccgaggcccctggcttcctcaaggaaaacggcgttcgcggcgacggcatcaactttgaccagggcgcacgcaccgccctggccttcgtgacctaacgcgccgacgggga

SEQ ID NO: 2663 - DNA, 168 bp, Glycine max
ctaaaatccaaacacactctctcttcccatggcgttgaacaatggcgtccccgccaccggcaccggcctcatcgtcagcttcggtgagatgctcatcgacttcgtccccaccgtctctggcgtgtccctggccgaggcccctggcttcctcaaggcccccggcggcgc

SEQ ID NO: 2664 - DNA, 286 bp, Glycine max
  unsure (1)..(286): unsure at all n locations
aaacagtgttccaaaatccaaacacactctctctccccatggcgttgaacaatggcgtccccgccaccggcaccggccttcatcgtcagctntcggtgagatgctcatcgacttcgtccccaccgtctctggcgtgtccctggccgaggccctggcttcctcaaggcccccggcggcgcccccgctaacgtcgcnatcgccgtgtcgcgcctcggcggcaaagcgctttcgtcggcaagctcggcgacgacgagttcggcaaaatgntcgccggantccccaagga

SEQ ID NO: 2665 - DNA, 304 bp, Glycine max
gttttccattacggatcaatcagtttgatcgtggagccatgcagatcagcacacttgaaggcaatggaagtagccaaggaatctgggtgcttgctctcctatgaccccaaccttcgtctacctttgtggccatcggctgaggaagctcgtaagcaaatactgagcatttgggagaaggctgatttgatcaaggtcagtgatgcggagcttgagttcctcacaggaagtgacaagattgatgatgaatctgctttgtcattgtggcaccccaatttgaagttgctccttgtcactcttggggaac

SEQ ID NO: 2666 - DNA, 280 bp, Glycine max
gttttccattacggatcaatcagtttgatcgtggagccatgcagatcagcacacttgaaggcaatggaagtagccaaggaatctgggtgcttgctctcctatgaccccaaccttcgtctacctttgtcgccttcggctgaggaagctcgtaagcaaatactgagcatttgggagaaggctgatttgatcaaggtcagtgatgcggacttgagttcctcacaggaagtgacaagattgatgatgaatctgctttgtcattgtggcaccccaatttgaagtt

SEQ ID NO: 2667 - DNA, 275 bp, Glycine max
caagattcatcatcaatcttgtgacaggaagtgacaagattcatcatcaatcttgtcacttcctgtgaggaactcaagctccgcatcactgaccttgatcaaatcagcctagtgccaaatgctcagtatttgcttacgagcttgctcagccgaaggcacaaaggtagacgaaggttggggtcataggagagcaagcacccagattccttggctacttccattgccttcaagtgtgctgatctgcatggctccacgatcaaactgattgatccgta

SEQ ID NO: 2668 - DNA, 247 bp, Glycine max
ggatcaatcagtttgatcgtggagccatgcagatcagcacacttgaaggcaatggaagtagccaaggaatctgggtgcttgctctcctatgaccccaaccttcgtctacctttgtggccttcggctgaggaagctcgtaagcaaatactgagcatttgggagaaggctgatttgatcaaggtcagtgatgcggacttgagttcctcacaggaagtgacaagattgatgatgaatctgctttgtcatt

SEQ ID NO: 2669 - DNA, 245 bp, Glycine max
ggatcaatcagtttgatcgtggagccatgcagatcagcacacttgaaggcaatggaagtagccaaggaatctgggtcttgctctcctatgaccccaaccttcgtctacctttgttgccttcggctgaggaagctcgtaagcaaatactgagcatttgggagaaggctgatttgatcaaggtcagtgatgcggagcttgagttcctcacaggaagtgacaagattgatgatgaatctgctttgtca

SEQ ID NO: 2670 - DNA, 253 bp, Glycine max
gtgaccctacgcgccgacggggagcgtgagttcatgttctacagaaaccccagcgccgacatgctcctcaagcccgaagaactcaatctcgaactcatcagatctgcaaaagttttccattacggatcaatcagtttgatcgtggagccatgcagatcagcacacttgaaggcaatggaagtagccaaggaatctgggtgcttgctctcctatgaccccaaccttcgtctacctttgtggccttcggctgagg

SEQ ID NO: 2671 - DNA, 234 bp, Glycine max
caatctcgaactcatcagatctgcaaaagttttccattacggatcaatcagtttgatcgtggagccatgcagatcagcacacttgaaggcaatggaagtagccaaggaatctgggtgcttgctctcctatgaccccaaccttcgtctacctttgtggccttcggctgaggaagctcgtaagcaaatactgagcatttgggagaaggctgatttgatcaaggtcagtgatgcgga

SEQ ID NO: 2672 - DNA, 263 bp, Glycine max
  unsure (1)..(263): unsure at all n locations
ctcaatctcgaactcatcagatctgcaaaagttttccattacggatcaatcagtttgatcgtggagccatgcagatcagcacacttgaaggcaatggaagtagccaaggaatctgggtgcttgctctcctatgaccccaaccttcgtctacccttgtggccttcggctgaggaagctcgtaagcaaatactgagcatttgggagaaggctgatttgatcaaggtcagtgatgcgganttgagttcctcacaggaagtgacaag

SEQ ID NO: 2673 - DNA, 229 bp, Glycine max
  unsure (1)..(229): unsure at all n locations
gctcctcaagcccgaagaactcaatctcgaactcatcagatctgcaaaagttttccattacggatcaatcagtttgatcgtggagccatgcagatcagcacacttgaaggcaatggaagtagccaaggaatctgggtgcttgctctcctatgaccccaaccttcgtctacctntgtngccttcggctgaggaagctcgtaagcaaatactgagcatttgggagaaggct

SEQ ID NO: 2674 - DNA, 256 bp, Glycine max
ggatcaatcagtttgatcgtggagccatgcagatcagcacacttgaaggcaatggaagtagccaaggaatctgggtgcttgctctcctatgaccccaaccttcgtctacctttgtgcgccttcggctgaggaagctcgtaagcaaatactgagcatttgggagaacgctgatttgatcaaggtcagtgatgcggacttgagttcctcacaggaagtgacaagattgatgatgaatctgctttgtcattgtggcacc

SEQ ID NO: 2675 - DNA, 323 bp, Glycine max
ttcggctcgagaatggcgcacgcaccgccctggccttcgtgaccctacgcgccgacggggagcgatagttcatgttctacagaaaccccagcgtcgacatgctcctcaagcccgaagaactcaatctcgaactcatcagatctgcaaaagttttcaattacggatcaatcagtttgatcgtggagccatgcagatcagcacacttgaaggcaatggaagtagccaaggaatctgggtgcttgctctcctatgaccccaaccttcgtctacctttgtggccttcggctgaggaagctcgtaagcaaatactgagcatttgggag

SEQ ID NO: 2676 - DNA, 380 bp, Glycine max
aaggctttggggagatgatgatcaatttggtccctacagtagcaagagtgtcccttgcagatgcaactgcctataagaaattcccttctggagccactgccaatgttgctgttggaatttgtagactaagaggctcagcagctttcattggcaaggtgggaaatgatgaatttggacatctgttatctgatattctgaaacaaaatggtgttgacaattctggcctgctctttgatgatcatgcaaggacagcgttgggaatttatgctcttaagagtaatggagaacctgaattcatgttttaccgaaatccaagttctgatgtgctccttcgtcctgatgaaattgatatggacctcataaagaaagcacaatatttc

SEQ ID NO: 2677 - DNA, 336 bp, Glycine max
  unsure (1)..(336): unsure at all n locations
gctcccaacagtgtccaaatccaacgcacactttttcccccatggggttgaacaatggcgtccccgccactggcaccggcctcatcgttagcttcggcgagatgctcatcgacttcgtccccaccgtctccggcgtgtccctggccgaggcccctggcttcctcaaggcccncggcggcgccccagccaacgtcgccatcgccgtgtcgcgactcggcggcaaagccgccttcgtcggcaaactcggggacgacgagttcggccacatgctcgccggaatccttaaggagaacggtgtccgcgccgacggcattaacttcgaccagggtgcacgca

SEQ ID NO: 2678 - DNA, 339 bp, Glycine max
gggagcgtgagttcatgttctacagaaaccccagcgccgacatgctcctcaagcccgaagaactcaatctcgaactcatcagatctgcaaaagttttccattacggatcaatcagtttgatcgtggagccatgcagatcagcacacttgaaggcaatggaagtagccaaggaatctgggtgcttgctctcctatgaccccaaccttcgtctacctttgtggccttcggctgaggaagctcgtaagcaaatactgagcatttgggagaaagctgatttgatcaaggtcagtgatgcggaagctgagttcctcacaggaagtgacaagattgatgatgaat

SEQ ID NO: 2679 - DNA, 271 bp, Glycine max
cagccgcagacagagatggaagctgtgtgtggaagtgtttgggtcacatcctctcttccacgctcacccaagtccactctctctctattccgctctactcatcaacacctaacagcatttccttcacaatcccatcttttcttatatcaccctcctccctatgctaatgctaaaaccctccgcgccagaacctcctccaaacccgccattttccttccccacttaattgcttctctggaacaagttgaccagacttacataatggtcaagc

SEQ ID NO: 2680 - DNA, 391 bp, Glycine max
acgcgtccagtacagctggccaaaaaacgaccgaagggggagataccaaggaaatttggttcttacctcttacccgcagacagatgaaagaagggaaatacatggaagctgtgtgtgcaagtggaagcagtgtttgggtcacatcctcgcttacacgcacacccaagatcacactccctctattccgcgccagttagcaccagctaacagcatttccttcacaatcccttcttttctcctatcacccttctcgctatgctaatgctagaaccctccgcgccacaacctcctccagacccattttccttccccacataagtgcatcactggaacaaatttactacacttatattatggtcaagcccgacggcgtcaaacgtggcctcgtggg

SEQ ID NO: 2681 - DNA, 405 bp, Glycine max
  unsure (1)..(405): unsure at all n locations
agacggctgcgagaagacgacagaaggggggttcttcttagccgtagttttctctcacagccgcagacagagatggaagctgtgtgtggaagtgtttgggtcacatcctctcttccacgctcacccaagtccactctctctctattccgctctactcatcaacacctaacagcatttccttcacaatcccatcttttcttatatcaccctcctccctatgctaatgctaaaaccctccgcgccagaacctcctccaaacccgccattttccttccccacttaattgcttctctggaacaagttgaccagacttacataatggtcaagcccgacggcgtgcaacgtggcctcgtgggagaaattacttctaggtttgagaaganagggtttaagtcaactggcttg

SEQ ID NO: 2682 - DNA, 237 bp, Glycine max
  unsure (1)..(237): unsure at all n locations
gaagcacttttggatgttgcgtcatgtcttgcaagcagtgctcagacccagaagggatggaatcgcataatatttgagaagccatttggctttgatgcactttcttcccataggctgacacaatatcttctttcaaactttcaggaaaagcaaatatatagaattgatcatctactaggaaggatatctcatgaaaactctacagntttaagggtttcaaagcgagnttttgagcca

SEQ ID NO: 2683 - DNA, 255 bp, Glycine max
ctgtgttgagttttccaaccttaaaaagactctctcttctctctcgctctttctctccctgaagcaaaacaacattagcatcaaaaccagagtggttctagtaatccggtgctgctagaggatgggaactagtgaatggcatatcgagcgaagatctagcttcggcactgaatcccccttagcaatataggcacgcaatgtgcctgaaactcgtcactctctattgtcgtgcttggcgcttctggggatcttgct

SEQ ID NO: 2684 - DNA, 260 bp, Glycine max
tatggaatcgcataatatttgataagccatttggctttgatgcactttcttcccataggctgacacaatatcttctttcaaactttcaggaaaagcagatatatagaattgatcatctactaggaaggaatctcattgaaaatcttacagttttaaggttttcaaatctagtttttgagccactttggagtcgtacttatatagataatgtacaggtcattttatcagaggacttggctgtgcatcctggaaatattcaa

SEQ ID NO: 2685 - DNA, 279 bp, Glycine max
tacggctgcgacaagacgacagaaggggagtgcgtgaagaaaacaccaactgttttgagttttccaaccttaaaaagactctctcttctctctctctctttctctacctgaagcaaaacaacattagcatcaaaaccagagtggttctagtaatccggtgctgctagaggatgcgaactagtgaatggcatatcgagcgaagatctagcttcggcactgaatcccccttagcaagagaggcaggaaatgtgcctgaaactgggtcactctctattgttg

SEQ ID NO: 2686 - DNA, 137 bp, Glycine max
ccaggcagtatataagacatggacagttgatattctcagaagattttggcactgaaggacgtggcgggtactttgaccattatggtatcatgagagacattatgcagaatcatttacttcaaatactagcactcttt

SEQ ID NO: 2687 - DNA, 284 bp, Glycine max
caaccttaaaagactctcttttctctctctgaactctgaagcaaaacaacattaccagagtggttctagtaattcagtgctgctagaagatggaaactagtgaatggcatatcgagcgaagatctagcttcggctctgaatcccccttagcaagagaggcaggaaatgtgcctgaaactgggtcactctctattgtggtgcttggtgcttctggtgatcttgctaagaagaagacatttcctgcacttttccacctatacctgcagggattcttaccaccagat

SEQ ID NO: 2688 - DNA, 242 bp, Glycine max
cttttctctctctgaactctgaagctaaacaacattaccagagtggttctagtaattcagtgctgctagaagatggaaactagtgaatggcatatcgagcgaagatctagcttcggctctgaatccccctagcaagagaggcaggaaatgtgcctgaaactgggtcactctctattgtggtgcttggtgcttctggtgatcttgctaagaagaagacatttcctgcacttttccacctatac

SEQ ID NO: 2689 - DNA, 194 bp, Glycine max
tgtttcagctaactctgcttcacttggtaattgagtggttctagtaatccggtgctgctagaggatgggaactagtgaatggcatatcgagcgaagatctagcttcggcactgaatcccccttagcaagatatgcaggaaatgtgcctgaaactgggtcactctctattgttgtgcttggcgcttctggggatc

SEQ ID NO: 2690 - DNA, 286 bp, Glycine max
  unsure (1)..(286): unsure at all n locations
cttactcctcctgcagttgaggcaatatcagagagttttggagagtggattatcaaaggtttaaagaaggaaaaaggataccctgtagagaatgttagancgtctctccgggcgtgaccctcgagtccacagggtcccaaattgagcgtcgcagttttgcaggtctggctcgcgccggttgcatggtgtatgatatgggactagccaccaccccggcttgtttcatgagcatttgttgcctccattgcctatgatgcttcaatgatgatganagcttctcacttgc

SEQ ID NO: 2691 - DNA, 269 bp, Glycine max
  unsure (1)..(269): unsure at all n locations
gtcttgctcgatcaatgccaacaagcggtgctctggaccgtgttgctaaaaaattgaacctccctttctttgaggtccccactggttggaaattttntgggaatcttatggatgctgggaatttgtccgttgcggggaagagagttttggaacaggttctgatcacattcgtgagaaagatggcatctgggctgtcttagcttggctttctattattgcacatcgcaacaaagacaagaatcccggggagaaattgatctccgtatctg

SEQ ID NO: 2692 - DNA, 289 bp, Glycine max
  unsure (1)..(289): unsure at all n locations
cttgctcgatcaatgccaacaagtggtgctttggaccgtnttgctgaaaaattngacctccctttctgtnaggcatgcttgatttttcttacaatttcnttcttcntaaatnattaatataaatganataggcttcacatatttttagacagttctgaaataacanaagatggacccgggattcagggccccactggttggnaattttttgggaatcttatggatgctgggaatttnncggtttgcggggaagnaagtttggaacaggttctgaccacatgcgtgagat

SEQ ID NO: 2693 - DNA, 298 bp, Glycine max
  unsure (1)..(298): unsure at all n locations
tngtcaacattctgtatgcngaaaatggacctgattttngagcagccagtnatggggatggtgatagaaatatgattttaggaagaagtttcttgtaactnccttcagactctgtagcagttattgcagccattgcaaganaagcgattcnatacttcaagaacggagttaagggtcttgctcgatcaatgccaacaagcggtgctctggaccgtgttgctaaaaaattgaacctccctttctttgaggtccccactggttggaaattttttgggaatcttatggatgctgggaattt

SEQ ID NO: 2694 - DNA, 264 bp, Glycine max
  unsure (1)..(264): unsure at all n locations
tttgtnaggttttttgtcactccttcagattccgtggccattatcgctgcaaatgcacttgaagctataccatacttttctgctggtttaaagggtgttgccaggagcatgccaacctctgctgccctggatgttgttgccaaattctgaatttgaaattttttgaggtccccacgggttggaagttcttggtantttaatggatgctggattgttcagtctgtggtgaagaaagtttgggatggttcgaccagttcgtgagna

SEQ ID NO: 2695 - DNA, 250 bp, Glycine max
cacattcgtgagacagatggcatctgggctgttttagctagattttctattattgcacatcgcaacaaagacaagaatcccggggagaaattgatctccgtatctgacgttgtgatggagcactgggcacttatggaaggaatttcttctctagatatgactacgaggaatgtgaatctgaaggtgccaataagatgatagaatacctacgagatattttgtctaagagcaagcctggtgatcagtatgg

SEQ ID NO: 2696 - DNA, 340 bp, Glycine max
cacacctgccgccagtcacatcatccggatacgaaaggcgaccggtggcatcctcctcactgccagccacaaccctggtggccccgatgaggactttggcatgaagtacaacctcgccaacggtgccccggctcccgagagcgtcaccaacaagatctacgaaacctccaagaccctctcgtcgtacaagatcgccgaactccccgacatcgacttgagcacaattggcacacaaaagtatggcagcctcgaggttgagatcgtccactcaacagaggactacctgaagatgctcaaggacatcttcgactttgacctcatcaagtcgttcctcaagcag

SEQ ID NO: 2697 - DNA, 228 bp, Glycine max
ctggtgggcccgacaatgatttcggcatcaagtacaacgtcaacaacggtggtccagctccagagagtgtgaccgacaagatcttccaacgcaccaaggagatttccgcctacaaggtccttgatgctggcgagcttgacctatccaagattagtagctccacctatggtcccatggaggttgagatcgtcgactcgctcaaggactatattaccctactcaaggaca

SEQ ID NO: 2698 - DNA, 231 bp, Glycine max
atttagtaaaagcagttcgcaaggcagctggaaacatagagaaaccattggagggtttccatatagttgttgatgcaggcaatggagcaggaggcttttttgcagcaaaggttctggaacctctgggggcaataacttctgggagtcaatttttggagcctgatggcttgtttccaaatcatatcccaaatcctgaggacaaaacagcaatgaaagctataacccaagcag

SEQ ID NO: 2699 - DNA, 265 bp, Glycine max
atcagatctgccagatgtggatatcaccacaacaggtgttacaagctttacaggccctgaaggaccatttgatgttgaggtttttgattcagcaagtgattatataaaattgatgaagtcaatttttgattttgaatctatcaggaaactgctgtcatctcctaaattcacattctgttatgatgcactacatggggttggtggagcatatgcaaagagtatatttgtggatgagcttggggcacaagaaagctctttactgaac

SEQ ID NO: 2700 - DNA, 266 bp, Glycine max
cgagctgatggatccagggcaacaggtgcatttatactgacagcaagtcacaatcctggtggccctcatgaggattttggaattaaatataatatggaaaacggtggacctgcaccagagggaattactgacaagatatatgaaaacacaacaacaattaatgagtacttgattgcatcagatctgccagatctggatatcaccacaacaggtgttacaagctttacaggccctgaaggaccatttgatgttgaggtttttgattc

SEQ ID NO: 2701 - DNA, 282 bp, Glycine max
gtttccaaatcatatcccaaatcctgaggacaaaacagcaatgaaagctataacccaagcagtccttgataacaaagctgatcttggaattatctttgatactgatgtggacagatctgctgctgtggatttcactggccgtgaattcaacaggaatcgtttaattgccttaatggcagctattgttcttgaggaacatcctggaacaactattgtcacagacagtgtgacttctgatgggcttaccacgtttattgagaagacacttggtggaagacacca

SEQ ID NO: 2702 - DNA, 277 bp, Glycine max
cacattttatgcctccactgggacaacctcaataaggaagatcacataaaaagtaacacacgttatatttttattgagaagcagcaccacaagcattgaagaaacttatcttagttctgtgttgtttaattgtctgtttgatttgagtggtttccaattacagggctgtcttagcttggctttctattattgcacatcgcaacaaagacaagaatcccggggagaaattgatctccgtatctgacgttgtgatggagcactgggcaacttatggaag

SEQ ID NO: 2703 - DNA, 261 bp, Glycine max
gcattgggctacttatgggcgccattattatactcgatatgactatgaaaacgtggatgcaggtgcagcaaaggaactgatggcatatttggtcaagctgcagtcctcactttcagaagtcaatcagattgttaaggggataaggtcagatgtttcgaatgttgtccacggtgatgaatttgagtacaatgatcctgtggatggttccatctcatcacatcagggaatccgatatttgtttgaggatggatcacgattgat

SEQ ID NO: 2704 - DNA, 300 bp, Glycine max
tctcgagccgaatcggctcgagtacggctgcgagaagacgtcagaacgggtggacagatctgctgctgtggatttcactggccgtgaattcaacaggaatcgtttaattgccttaatggcagctattgttcttgaggaacatcctggaacaactattgtcacagacagtgtgacttctgatgggcttaccacgtttattgagaagaaacttggtggcagacaccatcggttcaaaagaggctacaaagatgtgattgatgaagctattcgtttgaattctattggtgaggagtcacattt

SEQ ID NO: 2705 - DNA, 279 bp, Glycine max
  unsure (1)..(279): unsure at all n locations
ccaaaggaagacttcggaggaggacacccagaccccaatttgacatatgcaaaanagttggttgctcgtatgggattgggcaaatccgaaccccaagaagagcccccagagtttggtgctgcttctgatggtgatgcagatcgcaacatggttcttggtaaaaggttttntgtcactccttcagattccgtggccattatcgctgcaaatgctgttgaagctataccatacttttctgctggtttaaagggtgttgccaggagcatgccaacctctgct

SEQ ID NO: 2706 - DNA, 270 bp, Glycine max
ggagcatatgcaaagagtatatttgtggatgagcttggggcacaagaaagctctttactgaactgtacaccaaaggaagactttggaggaggacacccagaccccaatttgacatatgcaaaagagttggttgctcgtatgggattgggcaaatccgaaccacaagatgatcccccagagtttggtgctgcttctgatggtgatgcagatcgcaacatgatacttggtaaaaggttttttgtcactccttcagattccgtggccattatc

SEQ ID NO: 2707 - DNA, 272 bp, Glycine max
gcactacatggggttggtggagcatatgcaaagagtatatttgtggatgagcttggggcacaagaaagctctttactgaactgtacaccaaaggaagactttggaggaggacacccagaccccaatttgacatatgcaaaagagttggttgctcgtatgggattgggcaaatccgaaccacaagatgatcccccagagtttggtgctgcttctgatggtgatgcagatcgcaacatgatacttggtaaaaggttttttgtcactccttcaga

SEQ ID NO: 2708 - DNA, 263 bp, Glycine max
gcttggagcacaagaaagctctttactgaactgtacaccaaaggaagacttcggaggaggacacccagaccccaatttgacatatgcaaaagagttggttgctcgtatgggattgggcaaatccgaaccccaagaagagcccccagagtttggtgctgcttctgatggtgatgcagatcgcaacatggttcttggtaaaaggttttttgtcactccttcagattccgtggccattatcgctgcaaatgctgttgaagctatac

SEQ ID NO: 2709 - DNA, 269 bp, Glycine max
aaaattgatgaagtcaatttttgattttgaatctatcaggaaactgctgtcatctcctaaattcacattctgttatgatgcacctacatggggttggtggagcttatgcaaagagtatttttgtggatgagcttggagcacaagaaagctctttactgaactgtacaccaaaggaagacttctgaggaggatacccagactccagtttgacatatgcaaaagagtttgttgctcgtatgggattgggcaaatccggaccccaagaagag

SEQ ID NO: 2710 - DNA, 283 bp, Glycine max
  unsure (1)..(283): unsure at all n locations
ggcnagtgattntataanattgatgaagtcaattttngattttgaatctatcaggaaactgctgtcatctcctaaattccacattctgttatgatgcactacatggggnnggtggagcatatgcaaagagtatttttgtggatgagctggagcacaaganagctctttactgaactgtacaccaaaggaagacttcggaggaggacacccagaccccaatttgacatatgcaaaagcagttggttgctcgtatgggattgggcaaatccgnaccccaagaaga

SEQ ID NO: 2711 - DNA, 263 bp, Glycine max
atgagaaggatccatcaaagattgggagactttcaaatgaagcccttgctcctcttgtggaagttgcattgaaactttcgaagatggaagaattcactggtcgatccgctccaacagtcattacatgaacacatacaggtggaaggtggttagatcctgaagtttctcccagtcatttcttctttgttcagtttcttacggatggccgaacactagtgttggttgtttgcagcctttgctatgggcacttgagtggaatttga

SEQ ID NO: 2712 - DNA, 308 bp, Glycine max
gagaaggatccatcaaagattgggagactttcaaatgaagcccttgctcctcttgtggaagttgcattgaaactttcgaagatggaagaattcactggtcgatccgctccaacagtcattacatgaacacatacaggtggaaggtggttagatcctgaagtttctcccagtcatttcttctttgttcagtttcttacggatggccgaacactagtgttggttgtttgcagcctttgctatgggcatgagtggatttgatcagttacttatcaaaatttgatgtgctgaataagttgcaactgccgagt

SEQ ID NO: 2713 - DNA, 285 bp, Glycine max
caacaattcgattatacattgagcaatatgagaaggatccatcaaagattgggagactttcaaacgaagcacttgctcctgcttgtggaagttgcgttgaaactttcgaagatggaagaattcactggtcgatccgctccaacagtcattaatgaacacattcaagtggaaggtggttagatcctgaagcttctcccagtgcatttcatttcttctttgtccagtatcttacggatagccgaacagtagatttggttgtttgcagcctttgctatgggaaattga

SEQ ID NO: 2714 - DNA, 260 bp, Glycine max
gccagtcatggtgctcttcaatgtttcacgcgtagagaccactcccttcgatggccagaagcctgaaccctctggtctccgcaacaaggtgaaagtgttcgtgcaacctcattacctccataactttgttcagtcaacattcaatgcattaactgtggaaaaagttagaggtgcaacgctagttgtatctggtgatggtcgttatttttcaaaggtagctattcagattataactaaaatgtcagcagcaaatggagtaa

SEQ ID NO: 2715 - DNA, 252 bp, Glycine max
cgggtagccagccagtcatggtgctcttcaatgtttcacgcgtagagaccactcccttcgatggccagaagcctggaacctctggtctccgcaagaaggtgaaagtgttcgtgcaacctcattacctcctaactttgttcagtcaacattcaatgcattaactgtggaaaaagttagaggtgcaacgctagttgtatctggtgatggtcgttatttttcaaaggaagctattcagattataactaaaatgtc

SEQ ID NO: 2716 - DNA, 246 bp, Glycine max
gtttttctttgttccggtagccagccagccagccatggtgctcttcaatgtttcacgcgttgagaccaccccctccgatgcacacaagcctggaacctctcgtctccgcaagaaggtgaaagtattcgtgcaacctccttacctccataactttgtccagcccacattcaatgccttaactgtggaaaaagttagaggtgcaacgctagttgtatctggtgatggccgttatttctcaaaggaagc

SEQ ID NO: 2717 - DNA, 262 bp, Glycine max
tccggatttcgttttgctttgttcaggtagccagccagtcatggtgctcttcaatgtttcacgcgtagagtccactcccttcgatggcctgaatcctggaagctctggtctccgcaagaaggtgagtagtgttcgtgcaacctcattacctccataactttgttcagtcaacattcgttgcattaactgtggataaagttcgaggtgctgcgctagttgtatctggtgatggtcgtgattattcaaaggatgctattcagat

SEQ ID NO: 2718 - DNA, 295 bp, Glycine max
ttttcatcaactgctaagctaactgaactctctctcgttgttcccttggcctctcgctctataaatacacatcgcatcattctctcacttgcacattgaaatctgaaccttccggatttcgttttgctttgttcaggtagccagccagtcatggtgctcttcaatgtttcacgcgtagagaccactcccttcgatggccagaagcctggaacctctggtctccgcaagaaggtgaaagtgttcgtgcaacctcattacctccataactttgttcagtcaacattcaatgcattaa

SEQ ID NO: 2719 - DNA, 265 bp, Glycine max
ctgcgagaagacgacagaagggggcacattgaaatctgaaccttccggatttcgttttgctttgttcaggtagccagccagtcatggtgctcttcaatgtttcacgcgtagagaccactcccttcgatggccagaagccaggaacctctgtctccgcaagaaggtgaaagtgttcgtgcaacctcattacctccataactttgttcagtcaacattcaatgcattaactgtggagaaagttagaggtgcaacgctagttgtatct

SEQ ID NO: 2720 - DNA, 268 bp, Glycine max
gctaagctaactgaactctctctcgttgttcccttggcctctcgctctataaatacacatcgcatcattctctcacttgcacattgaaatctgaaccttccggatttcgttttgctttgttcaggtagccagccagtcatggtgctcttcaatgtttcacgcgtagagaccactcccttcgatggccagaagcctggaacctctggtctccgcaagaaggtgaaagtgttcgtgcaacctcattacctccataactttgttcagtcaa

SEQ ID NO: 2721 - DNA, 240 bp, Glycine max
acggctgcgagaagacgacagaagggggcacattgaaatctgaaccttccggatttcgttttgctttgttcaggtagccagccagtcatggtgctcttcaatgtttcacgcgtagagaccactcccttcgatggccagaagcctggaacctctggtctccgcaagaaggtgaaagtgttcgtgcaacctcattacctccataactttgttcagtcaacattcaatgcattaactgtggaa

SEQ ID NO: 2722 - DNA, 248 bp, Glycine max
acggctgctagaagacgacagaagggggcacattgaaatctgaaccttccggatttcgttttgctttgttcaggtagccagccagtcatggtgctcttcaatgtttcacgcgtagagaccactcccttcgatggcctgaagcctggaacctctggtctccgctagaaggtgaaagtgttcgtgcaacctcattacctccataactttgttcagtcaaggtttaatgcattaactgtggaaaaagttag

SEQ ID NO: 2723 - DNA, 244 bp, Glycine max
tgctcttcaatgtttcacgcgtagagactcatgactggctggctacctgaacaaagcaaaacgaaatccggaaggttcagatttcaatgtgctttgttcaggtagccagccagtcatggtgctcttcaatgtttcacgcgtagagaccactcccttcgatggccagaagcctggaacctctggtctcgcgcaagaaggtgaaagtgttcgtgccacctcattacctccataactttgttcagtc

SEQ ID NO: 2724 - DNA, 280 bp, Glycine max
caataaactgctaagctaactgaactctccctctctccttcctcgttcctttcgcctctcactacaaatacacatctcatctcatccgtctctcacttttaatttttctctgcaatctgaaccttccggatttcgtttttctttgttccggtagccagccagccagccatggtgctcttcaatgtttcacgcgttgagaccactcccttcgatggacagaagcctggaacctctggtctccgcaagaaggtgaaagtattcgtgcaacctcattacctcc

SEQ ID NO: 2725 - DNA, 140 bp, Glycine max
cagccagccagccatggtgctcatcaatgtttcacgcgttgagaccactcccttcgatggacagaagcctggaacctctggtctccgcaagaaggtgaaagtattcgtgcaacctcattacctccataactttgttcagt

SEQ ID NO: 2726 - DNA, 274 bp, Glycine max
ctactgctaagctaactgaactctccctctctccttcctcgttcctttcgcctctcactacaaatacacatctcatctcatccgtctctcacttttaattattctctgcaatctgaaccttccggatttcgtttctctttgttccggtagccagccagccagccatggtgctcttcaatgtttcacgcgttgagaccactcccttcgatggacagaagcctggaacctctggtctccgcaagaaggtgtcagtattcgtgcaatctcattacct

SEQ ID NO: 2727 - DNA, 237 bp, Glycine max
catcaactgctaagctaactgaactctctctcgttgttcccttggcctctcgctctataaatacacatcgcatcattctctcacttgcaaattgaaatctggaacttccggatttcgttttgctttgttcaggtagccagccagtcatggtgctcttcaatgtttcacgcgtagagaccactcccttcgatggccagaagcctggaacctctggtctccgcaagaggtgaagtgttc

SEQ ID NO: 2728 - DNA, 272 bp, Glycine max
gctggattatgttcagtctgtggtgaagaaagttttgggactggttctgaccatattcgtgagaaagatggaatatgggcagttttggcatggctatctatacttgcatatagaataaagataaacttgaagacaagcttgtcactgttgaagacatagttcgccagcattgggctacttatgggcgccattattatactcgatatgactatgaaaatgtggatgcaggtgcagcaaaggaactgatggcatatttggtcaagctgcagtcc

SEQ ID NO: 2729 - DNA, 197 bp, Glycine max
gctggattatgttcagtctgtggtgaagaaagttttgggactggttctgaccatattcgtgagaaagatggaatctgggcagttttggcctggctatctatacttgcatataaaaataaagataaacttgaagacaagcttgtcactgttgaagacatagttcgccagcattgggctacttatgggcgccattatta

SEQ ID NO: 2730 - DNA, 237 bp, Glycine max
cctcgagccgattcggtcgagtggaagttctttggtaatttaaacgatgctggattatgactcagtctgtggtgaagaaacttttgggactggttctgaccatattcgtgagaaagatggaatctgggcagttttggcctggctatctatacttgcatataaaaataaagataaacttgaagacaagcttgtcactgttgaagacatagttcgccagcattgggctacttatgggcg

SEQ ID NO: 2731 - DNA, 257 bp, Glycine max
  unsure (1)..(257): unsure at all n locations
ggaatctgggcagttttggcctggctatctatacttgcatataaaaatanagataaacttgaagacaagcttgtcactgttgaagacatagttcgccagcattgggctacttatgggcgccattattatactcgatatgactatgaaaatgtggatgcaggtgcagcaaaggaactgatggcatatttggtcaagctgcagtcctcactttcagaagtcaatcagattattaaggggataaggtcagatgtttcgaa

SEQ ID NO: 2732 - DNA, 266 bp, Glycine max
gtacaatgatcctgtggatggttccatctcatcatatcagggaatccgatatttgtttgaggatggatcacgattgattttccgcctatctggaactggatcagaaggtgcaacaattcgactatacattgagcactatgagaaggatccatcaaagattgggagactttcaaatgaagcccttgctcctcttgtggaagttgcattgaaactttcgaagatggaagaattcactggtcgatccgctccaacagtcattacatgaa

SEQ ID NO: 2733 - DNA, 243 bp, Glycine max
  unsure (1)..(243): unsure at all n locations
gtacaatgatcctgtggatggttccatctcatcacatcagggaatccgatatttgtttgaggatggatcacgattgattttccgcctatctggaactggatcagaaggtgcaacaattcgattatacattgagcaatatgagaaggatccatcaaagattgggagactttcaaacgaagcacttgctcctcttgtggaagttgcgttgaaactttcgaagatggaaganttcactggtcgatc

SEQ ID NO: 2734 - DNA, 272 bp, Glycine max
tacggctgcgagaagacgacagaagggggataaggtcagatgtttcgaatgttgttcacggtgatgaatttgagtacaatgatcctgtggatggttccatctcatcacatcagggaatccgatatttgtttgaggatggatcacgattgattttccgcctatctggaactggatcagaaggtgcaacaattcgactatacattgagcaatatgagaaggatccatcaaagattgggagactttcaaatgaagcccttgctcctcttgtggaa

SEQ ID NO: 2735 - DNA, 288 bp, Glycine max
ctccgtcttacggcaattgaaggaagcactatctctgcaacttccgtcacattcacatggcagcttctgcatctgctactgctgtgccatatctagacaagacagattttctaaagcttcaaaatggcagtgacattcgtggtgtggctgttgatggtgttgagggagagccagttaacctcactgaacctgttgccgaagcaataggagctgcttttgctgcatggttagtggagaaaaagaaagctgatgcttctcagcatttgagagtttctattggtcatgatt

SEQ ID NO: 2736 - DNA, 368 bp, Glycine max
atcctggaacaactattgtcacagacagtgtgacttctgatgggcttaccacgtttattgagaagaaacttggtggcagacaccatcggttcaaaagaggctacaaaaatgtgattgatgaagctattcgtttgaattctattggtgaggagtcacatttggcaattgaaactagtggacatggagctctcaaggaaaatcattggcttgatgatggcgcatacctaatggtcaagatcttaaataaacttgcttctgcaagagcttctggaaagggtggtggaagtaaggttttgactgatctaatagacggacttcaggaaccagattttgctgtagaactgagattaaagataaaccaaaaccat

SEQ ID NO: 2737 - DNA, 414 bp, Glycine max
caagcccattgatggacaaaagactggaaccagtgggcttcgaaagaaggtgaaagtgtttatgcaagacaattaccttgcaaattggatccaggctctgtttaattcattgccaccggaggactacaagaatggtttgttggtgttgggaggtgatggtcgatactttaatcaggaagctgcacagataataatcaaaattgctgctggaaatggtgttggaaaaattctggttggaaaggaaggtattttgtcaacaccagccgtttctgctgttataagaaagagaaaggcaaatggtggatttattatgagtgcaagccataatcctggcggacctgaatatgattggggtattaagtttaattacagcagtggacaacctgcaccagaatccatcactgacaagattta

SEQ ID NO: 2738 - DNA, 412 bp, Glycine max
gaaccttccggatttcgttttgctttgttcaggtagccagccagtcatggtgctcttcaatgtttcacgcgtagagaccactcccttcgatggccagaagcctggaacctctggtctccgcaagaaggtgaaagtgttcgtgcaacctcattacctccataactttgttcagtcaacattcaatgcattaactgtggaaaaagttagaggtgcaacgctagttgtatctggtgatggtcgttatttttcaaaggaagctattcagattataactaaaatgtcagcagcaaatggagtaagacgtgtttggattggtcaaaatggattgctttcaactcctgcagtatctgctgttatacgtgaaagagttggagctgatggattcagggcaacaggtgcatttatactgaca

SEQ ID NO: 2739 - DNA, 396 bp, Glycine max
  unsure (1)..(396): unsure at all n locations
caataaactgctaagctaactgaactctccctctctccttgctcgctcctttcgcctctcactacaaatacacatctcatctcatccgtctctcacttttaatttttctctgcaatctgaaccttccggatttcgtttttctttgttccggtagccagccagccagccatggtgctcttcaatgtttcacgcgttgagaccactcccttcgatggacagaagcctggaacctctggtctccgcaagaaggtgaaagtattcgtgcaacctcattacctncataactttgttcagtcaacattcaatgcattaactgtggaaaaagttagaggtgcaacgctagttgtatctggtgatggtcgttatttttcaaaggaagctattcagattataact

SEQ ID NO: 2740 - DNA, 358 bp, Glycine max
gcgaattcagctcgagcaattaactgttaagctaactgaactctccctctgtcctgcctcattcctttggcctctcactacaaatacacatctcatctcatccgtctctcacttttaatttttctctgcaatctgaaccttccggatttcgctattctttgttccggtagccagtcagccagccatcgtgctctacaatgtttcacgcgttgagaccactcccttcgatggacagaagcctggaacctctggtctcctcacgaacgtgaccgtattcgtgcaacctcattacctccataacttcgatcagtcaacattcaatgcattaactgtggaaaaagttagaggtgcaacgcta

SEQ ID NO: 2741 - DNA, 251 bp, Glycine max
  unsure (1)..(251): unsure at all n locations
acagtttgatggtgagaggtgatgtgtggtttggggctaatattactttgaaggggcaagtgactattgctgcaaaacctggcttgaaattggaaattcctgatggggtgacgattgagaataaggagatcaacgaccctgcagatatctaaggatgaatgttgtcgaattgctgagatttggtccagtgatacatgactgctgaactttgattnccaggcaanacatttagttgnccctttgcccccccc

SEQ ID NO: 2742 - DNA, 256 bp, Glycine max
caaagctagggcaaatcctgaaaacccttctattgaacttgggccagaatttaagaaggttagcaacttcttgggccgcttcaagtcaattcccagtattgttgagcttgacagtctaaaagtggctggcaatgtatggtttggagatggtgttatcctcaagggaaaaatcagtatcgtggccaatcctggtgttaagctggaagttcccgatggtgctgtcatttcggataaggaaattaatggcccagaggac

SEQ ID NO: 2743 - DNA, 264 bp, Glycine max
ctggccttttgttctcgtgtcaatttctaaatccaccaccacaccctctcttctattctctattattattatctccacacccttcactctccctcagtcttctctcgaatcttccaccgcaatggccacccctgccgagaaactctccgctctcaaatccgccgtcgccggattgaacgaaatcagtgagaatgagaagaacggattcatcagcctcgtcggccgctatctcagtggcgaacgcagcatgtggaatggagcaag

SEQ ID NO: 2744 - DNA, 253 bp, Glycine max
agtatatcctagtgttgaagtcggacaatgtggcaacagtccttgatccaaacatactaaatcatttgatgataaatgatattgaatattgcatggaggtgacaccaagcaattcgtttaatttaatgttacccacaacgaaatttaagcttcgggagattggtggagaccaagataaacacttgaaggacaatttcaaactcatcgatacaacaaacatgtgggtgagtttaagagccatcaagaggtttgt

SEQ ID NO: 2745 - DNA, 243 bp, Glycine max
caaatctgcaattgatatttgtgatggactgacatatctggatttgatcattaaccagattgagaccctcaattccaagtatggaagcagggttccattgcttcttttcaataaagatgacattcatgatagttctctaaaggttttggagaagtattctaaatcaagtgttgaagtgcacacttttaaacagggtgaagatcgagagttgaaatcattgggtgaatatatagcaaggaggaa

SEQ ID NO: 2746 - DNA, 255 bp, Glycine max
tcctccgtcgctgcattgagccaaatcagtgagaatgagaagaatggattcacaagcctcgttgctcgttacctcagtggcgaagacagcatgttgagtggagtaagatcgagacgcctacggatgaagtagtggtgccttatgactctttggcaccgactcctgacggttctttggaggtgaagaacctcttggacaagcttgtggtgttgaagctcaatggaggcttggggacaactatgggttgtactggcc

SEQ ID NO: 2747 - DNA, 260 bp, Glycine max
  unsure (1)..(260): unsure at all n locations
ggagnngtattctaaatcaagtgttgaagtgcacacttttaaacagggtgaagatcgagagttgaaatcattgggtgaatattatagcaaggaggaagtgcatccatttgatgatgttgatgtgttccgtttactaatgactggtggaacccttgattcattattatcacagggtaaggagtatatcctagtgttgaagtcggacaatgtggcaacagtccttgatccaaacatactaaatcatttgatgataaatgata

SEQ ID NO: 2748 - DNA, 282 bp, Glycine max
  unsure (1)..(282): unsure at all n locations
atgaactcattcaacactcatgatgacactcaaaagattgttgagaaatataaaaactcaaatattgagattcatacgtttaaccagagtcaatatcctcgtttggttgttgatgnctttttgccattcccatccaaggggcagacaggcagggacgggtggtaccctcctggccacggagacgtcttcccatcattagtgaatagtggaaagcttgatgtgctattatcacagggtaaggagtatgtgtttgttgccaattcagacaacctggtgctgtag

SEQ ID NO: 2749 - DNA, 240 bp, Glycine max
  unsure (1)..(240): unsure at all n locations
cttccaccgcaatggccacggngccgagaaactctccgctctcacatccgcngtcgccggattnancgaaatcantgagaatgagaagaacggattcatcagcctcgtcggccgctatctcagtggcgaangcagcatgtggaatggagnaagatccagacgctanggacgaatggttgtncctacgacantnggcgccanctcngnaggtncnnggggnaaatnatggaaanctgtgnt

SEQ ID NO: 2750 - DNA, 275 bp, Glycine max
  unsure (1)..(275): unsure at all n locations
aatttctaaatccaccaccacaccctctcttctcttctcttctctccactcaacacaacgtcgcctncttcttctctcgaaccctnnagcgnaatgaccacccgcaccgagaagctctccgctctcaaatccgccgtcgccggatcgaacgaaatcagtgagagtgagaagaacccattcatcagcctcgtcagccgctatctcagtggcgaacgcagcatgtggaatggagcaagatccagacgcctacggacgaagtggttgtgccttacgac

SEQ ID NO: 2751 - DNA, 312 bp, Glycine max
ttcggctcgacgtcacagggtaaagagtatgtatttcttgccaattcagataacttgggagctatagttgacttgatgtacttgactcattgatgtagagatcttaaatcatttgatccagaacaagaatgaatactgtatggaggtgactcccaaaacattggctgatgtaaagggtggcactttgatttcttacgaaggaagggttcagcttttggaaattgcacaagtcccagatgaacatgtcaatgagttcaagtcaatagagaagttcaaaattttcaacacaaatcatagtcggtgaacttaaat

SEQ ID NO: 2752 - DNA, 209 bp, Glycine max
gctcggaatcggccgagctcgagccgcgaagcagcgtgtggaatggagcaagatccagacgcctacggacgaagtggttgtgccttacgagactttggcgccaactcctgaaggttcttcggaggtgaagaatctattggacaagcttgtggtgttgaagctaaatggaggcttgggaacaactatgggttgcactggtcctaaatctg

SEQ ID NO: 2753 - DNA, 277 bp, Glycine max
ctccgctctcaaatccgccgtcgccggattgaacgaaatcagtgagaatgagaagaacggattcatcagcctcgtcggccgctatctcagtggcgaacgcagcatgtggaatggagcaagatccagacgcctacggacgaagtggttgtgccttacgacactttggcgccaactcctgaaggttcttcggaggtgaagaatctattggacaagcttgtggtgttgaagctaaatggaggcttgggaacaactatgggttgcactggtcctaaatctg

SEQ ID NO: 2754 - DNA, 245 bp, Glycine max
ccctcgagccgaatcggctcgagcggctcgagcgctatctcagtggacccgcagatgtggactggagcaagatccagacgactacggacgacagtggttgtgccttacgacactttggcgccaactcctgaaggttcttcggaggtgaagaatctattggacaagcttgtggtgttgaagctaaatggaggcttgggaacaactatgggttgcactggtcctaaatctgtaattgaagttcgtga

SEQ ID NO: 2755 - DNA, 270 bp, Glycine max
ttccaccgcaatggccaccgctgccgagaaactctccgctctcaaatccgccgtcgccggattgaacgaaatcagtgagactgagaagaacggattcatcagcctcgtcggccgctatctcagtggcgaacgcagcatgtggaatggagcaagatccagacgcctacggacgaagtggttgtgccttacgacactttggcgccaactcctgaaggttcttcggaggtgaagaatctattggacaagcttgtggtgttgaagctaaatgga

SEQ ID NO: 2756 - DNA, 219 bp, Glycine max
cgccaccgctgccgagaaactctccgctctcaaatccgccgtcgccggattgaacgaaatcagtgagaatgagaagaacggattcatcagcctcgtcggccgctatctcagtggcgaacgcagcatgtggaatggagcaacatccagacgcctacggacgaagtggttgtgccttacgacactttggcgccaactcctgaaggttcttcggaggtgaag

SEQ ID NO: 2757 - DNA, 217 bp, Glycine max
accgcaatggccaccgctgccgagaaactctccgctctcaaatccgccgtcgccggattgaacgaaatcagtgagaatgagaagaacggattcatcagccttgtcggccgctatctcagtggcgaacgcagcatgtggaatggttcaagatccagacgcctacggacgaagtggttgtgccttacgacactttggcgccaactcctgaaggttcttc

SEQ ID NO: 2758 - DNA, 286 bp, Glycine max
ctggccttttgttctcgtgtcaatttctaaatccaccaccacacactctcttctattctctattattattatctccacacccttcactctctctcactcttctctcgaatcttccaccgcaatggccaccgctgccgagaaactctccgctctcaaatccgccgtcgccggattgaacgaaatcagtgagaatgagaagaacggattcatcagcctcgtcggccgctatctcagtggcgaacgcagcatgtggaatggagcaagtccagacgcctacggacgaatg

SEQ ID NO: 2759 - DNA, 262 bp, Glycine max
cttcactctctctcactcttctctcgaatcttccaccgcaatggccaccactgccgagaaactctccgctctcaaatccgccgtcgccggattgaacgaaatcagtgagaatgagaagaacggattcatcagcctcgtcggccgctatctcagtggcgaacgcagcatgtggaatggagcaagatccagacgcctacggacgaagtggatgtgcctacacgacactttggcgccaactcctgaaggttcttcggaagtgaag

SEQ ID NO: 2760 - DNA, 263 bp, Glycine max
ctggccttttgttctcgtgtcaatttctaaatccaccaccacaccctctcttctattctctattattattatgtccacacccttcactctgtctcactcttctctcgaatcttccaccgcaatggccacccctgccgagaaactctccgctctcaaatccgccgtcgccggattgaacgaaatcagtgagaatgagaagaacggattcatcagcctcgtcggccgctatctcagtggcgaacgcagcatgtggaatggagcaa

SEQ ID NO: 2761 - DNA, 259 bp, Glycine max
ctggccttttgttctcgtgtcaatttctaaatccaccaccacaccctctcttctattctctattattattatctccacacccttcactctctctcactcttctctcgaatcttccaccgcaatggccaccgatgccgagaaactctccgctctcaaatccgccgtcgccggattgaacgaaatcagtgagaatgagaagaacggattcatcagcctcgtcggccgctatctcagtggcgaacgcagcatgtggaatgga

SEQ ID NO: 2762 - DNA, 243 bp, Glycine max
cgtgtcaatttctaaatccaccaccacaccctctcttctattctctattattattatctccacacccttcactctctctcactcttctctcgaatcttccaccgcaatggccaccgctgccgagaaactctccgctctcaaatccgccgtcgccggattgaacgaaatcagtgagaatgagaagaacggattcatcagcctcgtcggccgctatctcagtggcgaacgcagcatgtggaatgg

SEQ ID NO: 2763 - DNA, 254 bp, Glycine max
ctggccttttgttctcgtgtcaatttctaaatccaccaccacaccctcacttctattctctattattattatctccacacccttcactctctctcactcttctctcgaatcttccaccgcaatggccacccctgccgagaaactctccgctctcaaatccgccgtcgccggattgaacgaaatcagtgagaatgagaagaacggattcatcagcctcgtcggccgctatctcagtggcgaacgcagcatgtgga

SEQ ID NO: 2764 - DNA, 268 bp, Glycine max
ctggccttttgttctcgtgtcaatttctaaatccaccaccacaccctctcttctattctctattattattatctccacacccttcactctctctcactcttctctcgaatcttccaccgcaatggccacccctgccgagaaactctccgctctcaaatccgccgtcgccggattgaacgaaatcagtgagaatgagaagaacggattcatcagcctcgtcggccgctatctcagtggcgaaggcagcatgtggactggagcaagatcc

SEQ ID NO: 2765 - DNA, 243 bp, Glycine max
actacactggccttttgttctcgtgtcaatttctaaatccaccaccacaccctctcttctattctctattattattatctccacacccttcactctctctcactcttctctcgaatcttccaccgcaatggccaccgctgccgagaaactctccgctctcaaatccgccgtcgccggattgaacgaaatcagtgagaatgagaagaacggattcatcagcctcgtcggccgctatctcagtgg

SEQ ID NO: 2766 - DNA, 254 bp, Glycine max
ctacactggccttttgttctcgtgtcaatttctaaatccaccaccacaccctctcttctattctctattattattatctccacacccttcactctctctcactcttctctcgaatcttccaccgcaatggccacctctgccgagaaactctccgctctcaaatccgccgtcgccggattgaacgaaatcagtgagaatgagaagaacggattcatcagcctcgtcggccgctatctcagtggcgaacgcagcat

SEQ ID NO: 2767 - DNA, 235 bp, Glycine max
cccttttgttctcgtgtcaatttctaaatccaccaccacaccctctcttctattctctattattattatctccacacccttcactctccctcactcttctctcgaatcttccaccgcaatggccacctctgccgagaaactctccgctctcaaatccgccgtcgccggattgaacgaaatcagtgagaatgagaagaacggattcatcagcctcgtcggccgctatctcagtggc

SEQ ID NO: 2768 - DNA, 262 bp, Glycine max
cataacctcgctctcttcaccctcttcttcttcttcttcttcttcactttgtaactttcgaatcttcttccttccaccgcaatggccactcccacgcttagccccgccgacgccgacaagctctccaacctcaaatcctccgtcgctgcattgagccaaatcagtgagaatgagaagaatggattcacaagcctcgttgctcgttacctcagtggcgaagacagcatgttgagtggagtaagatcgagacgcctacggatga

SEQ ID NO: 2769 - DNA, 255 bp, Glycine max
tcgctctcttcaccctcttcttcttcttcttcttcttcactttgtaactttcgaatcttcttccttccaccgcaatggccaccgccacgcttagccccgccgacgccgacaagctctccaacctcaaatcctccgtcgctgcattgagccaaatcagtgagaatgagaagaatggattcacaagcctcgttgctcgttacctcagtggcgaacacagcatgttgagtggagtaagatcgagacgctacggatgaa

SEQ ID NO: 2770 - DNA, 245 bp, Glycine max
agctctcttcaccctcttcttcttcttcttcttcttcactttgtaactttcgaatcttcttccttccaccgcaatggccaccaccacgcttagccccgccgacgccgacaagctctccaacctcaaatcctccgtcgctgcattgagccaaatcagtgagaatgagaagaatggattcacaagcctcgttgctcgttacctcagtggcgaacacagcatgttgagtggaggtgctgaagctcaat

SEQ ID NO: 2771 - DNA, 309 bp, Glycine max
ttgaaaatcttaaatcatttgatccagaacaagaatgaatactgtatggaggtgactcccaaaacattggctgatgtaaagggtggcactttgatttcttacgaaggaagggttcagcttttggaaattgcacaagtcccagatgaacatgtcaatgagttcaagtcaatagagaagtgcaaaattttcaacacaaataatttgtgggtgaacttaaatgcagttaaaaggcttgttgaagctgatgctcttaagatggaaattattcccaatccaaaggaagttgatggaataaaagttcttcagctg

SEQ ID NO: 2772 - DNA, 297 bp, Glycine max
atgcactattgtcacagggtaaagagtacgtgtttgttgccaattcggataacttgggagctatagttgacttgaaaatcttgaatcatttgatccagaacaagaatgaatactgtatggaggtgactcccaaaacattggctgatgtaaaggggggcactttgatttcttacgaaggaagggttcagctcctggaaattgcacaagtcccagatgaacatgtcaatgagttcaagtcaatagagaagttcaaaattttcaacacaaataatttgtgggtgaacttaaacgcattaa

SEQ ID NO: 2773 - DNA, 276 bp, Glycine max
tgtgaaaggtggcactctgatttcttatgaaggaagggttcagctcctggaaattgcccaagtaccagatgaacatgtcagtgaatttaagtctatagagaaattcaaaattttcaacacaaataatttgtgggtaaacttgaaagcaattaaaaggcttgttgaagctgatgctctgaagatggaaattattcccaatccaaaggaagtcgatggagtaaaagttcttcaattggaaactgcagctggtgcagcaataaggttctttgacaaagc

SEQ ID NO: 2774 - DNA, 276 bp, Glycine max
ttcggataacttgggagctatagttgacttgaaaatcttgaatcatttgatccagaacaagaatgaatactgtatggaggtgactcccaaaacattggctgatgtaaagggtggcactttgatttcttacgaaggaagggttcagctcctggaaattgcacaagtccccgatgaacatgtcaatgagttcaagtcaatagagaagttcaaaattttcaacacaaataatttgtgggtgaacttaaacgcagttaaaaggcttgttgaagctgatgc

SEQ ID NO: 2775 - DNA, 266 bp, Glycine max
gtggcactttgatttcttacgaaggaagggttcagctcctggaaattgcacaagtccccgatgaacatgtcaatgagttcaagtcaatagagaagttcaaaattttcaacacaaataatttgtgggtgaacttaaacgcagttaaaaggcttgttgaagctgatgctcttaagatggaaattattcccaatccaaaggaagttgacggaataaaagttcttcagctggaaactgcagctggtgctgcaataaggttctttgacaag

SEQ ID NO: 2776 - DNA, 251 bp, Glycine max
gtggcactttgatttcttacgaaggaagggttcagctcctggaaattgcacaagtccccgatgaacatgtcaatgagttcaagtcaatagagaagttcaaaattttcaacacaaataatttgtgggtgaacttaaacgcagttaaaaggcttgttgaagctgatgctcttaagatggaaattattcccaatccaaaggaagttgacggaataaaagttcttcagctggaaactgcagctggtgctgcaata

SEQ ID NO: 2777 - DNA, 253 bp, Glycine max
cttttggaaattgcacaagtcccagatgaacatgtcaatgagttcaagtcaatagagaagttcaaaattttcaacacaaataatttgtgggtgaacttaaatgcagttaaaaggcttgttgaagctgatgctcttaagatggaaattattcccaatcctaaggaagttgatggaataaaagttcttcagctggaaactgcagctggtgctgcaataaggttctttgacaaggctattgggattaatgttcctc

SEQ ID NO: 2778 - DNA, 249 bp, Glycine max
gggtggcactttgatttcttacgaaggaagggttcagctcctggaaattgcacaagtccccgatgaacatgtcaatgagttcaagtcaatagagaagttcaaaattttcaacacaaataatttgtgggtgaacttaaacgcagttaaaaggcttgttgaagctgatgctcttaagatggaaattattcccaatccaaaggaagttgacggaataaaagttcttcagctggaaactgcagctggtgctgc

SEQ ID NO: 2779 - DNA, 275 bp, Glycine max
acctgcgagaagacgacagaagggcccgatgaacatgtcaatgagttcaagtcaatagagaagttcaaaattttcaacacaaataatttgtgggtgaacttaaacgcagttaaaaggcttgttgaagctgatgctcttaagatggaaattattcccaatccaaaggaagttgacggaataaaagttcttcagctggaaactgcagctggtgctgcaataaggttctttgacagggctattgggattaatgttcctcgatcacgattccttcctgt

SEQ ID NO: 2780 - DNA, 276 bp, Glycine max
  unsure (1)..(276): unsure at all n locations
ctttgacaaggctattgggattaatgttcctcgatcacgattccntcctgtgaaggcaacttcagatttgcttcttgtccagtctgacctctacactttggaagacggatttgtcattcggaacaaagctagggaaaatcctgaaaacccttctattgaactgggaccagaatttaagaaggttagcaacttcttgggccgcttcaagtcaattcctagtatcgttgagcttgacagtctaaaagtggctggtgatgtatggtttggagctggtgt

SEQ ID NO: 2781 - DNA, 279 bp, Glycine max
ccaatccaaaggaagttgacggaataaaagttcttcagctggaaactgcagctggtgctgcaataaggttctttgacaaggctattgggattaatgttcctcgatcacgattccttcctgtgaaggcaacttcagattgcttcttgtccagtctgacctctacactttggaagacggatttgtcattcggaacaaagctagggaaaatcctgaaaacccttctattgaactgggaccagaatttaagaaggttagcaacttcttgggccgcttcaagtc

SEQ ID NO: 2782 - DNA, 273 bp, Glycine max
tacggctgcgagaagacgacagaagggagggtaaagagtatgtgtttgttgccaattcggataacttgggagctatagttgacttgaaaatcttgaatcatttgatccagaacaagaatgaatactgtatggaggtgactcccaaaacattggctgatgtaaagggtggcactttgatttcttacgaaggaagggttcagctcctggaaattgcacaagtccccgatgaacatgtcaatgagttcaagtcaatagagaagttcaaaattttca

SEQ ID NO: 2783 - DNA, 277 bp, Glycine max
tacggctgcgagaagacgacagaagggagggtaaagagtatgtgtttgttgccaattcggataacttgggagctatagttgacttgaaaatcttgaatcatttgatccagaacaagaatgaatactgtatggaggtgactcccaaaacattggctgatgtaaagggtggcactttgatttcttacgaaggaagggttcagctcctggaaattgcataagtccccgatgaacatgtcaatgagttcaagtcaatagagaagttcaaaattttcaacac

SEQ ID NO: 2784 - DNA, 270 bp, Glycine max
caggagctgaacccttccttcgtaagaaatcaaagtgccaccctttacatcagccaatgagttcaagtcaatagagaagttcaaaattttcaacacaaataatttgtgggtgaacttaaacgcagttaaaaggcttgttgaagctgatgctcttaagatggaaattattcccaatccaaaggaagttgacggaataaaagttcttcagctggaaactgcagctggtgctgcaataaggttctttgacaaggctatgggattaatgttcct

SEQ ID NO: 2785 - DNA, 292 bp, Glycine max
  unsure (1)..(292): unsure at all n locations
cttaaacgcagttanaaaggcttgttgaagctgatgctcttaagatggaaattattcccaatccaaaggaagttgacggaataaaagttcttcagctggaaactgcagctggtgctgcaataaggttctttgacaaggctattgggattaatgttcctcgatcacgattccttcctgtgaaggcaacttcagatttgcttcttgtccagtctgacctctacactttggaagacggatttgtcatcggaacaaagctagggaaaatcctgaaaaccttctatgaactgggaca

SEQ ID NO: 2786 - DNA, 191 bp, Glycine max
gtaaagggtggcactttgatttcttacgaaggaagggttcagctcctggaaattgcaaagtccccgatgaacatgtcaatgagttcaagtcaatagagaagttcaaaattttcaacacaaataatttgtgggtgaacttaaacgcagttaaaaggcttgttgaagctgatgctcttaagatggaaattatt

SEQ ID NO: 2787 - DNA, 130 bp, Glycine max
attcggataacttgggagctatagttgactggaaaatcttgaatcatttgatccagaacaagaatgaatactgtatggaggtgactcccaaaacattggctgatgtaaagggtggcactttgacttctta

SEQ ID NO: 2788 - DNA, 253 bp, Glycine max
gacggatttgtcattcggaacaaagctagggaaaatcctgaaaacccttctattgaactgggaccagaatttaagaaggttagcaacttcttgagtcgctacatcaccgttcctagtaacggacatcatgcttccctaaaagttgctaatcatctatagttctgagcctcgttcatcctcaaggggaccatcatcattgtatcaaaacccggtgttaagctataagttcccgacggtgttgccattgtagaca

SEQ ID NO: 2789 - DNA, 236 bp, Glycine max
ctttttgccattcccatccaaggggcagacaggcagggacgggtgagtacctcctggccacggagacgtcttcccatcattagtgaatagtggaaagcttgatgtgctattatcacagggtaaggagtatgtgtttgttgccaattcagacaacctgggtgctgtagttgacttgaaaatcttaaatcatttgattgagcacaagaatgaatactgtatggaggtcactcccaaga

SEQ ID NO: 2790 - DNA, 253 bp, Glycine max
acaggcacggacgggtggtaccctcctggccacggagacgtcttcccatcattagtgaatagtggaaagcttgatgtgctattatcacagggtaaggagtatgtgtttgttgccaattcagacaacctgggtgctgtagttgacttgaaaatcttaaatcatttgattgagcacaagaatgaatactgtatggaggtcactcccaagacattggctgacgtgaaaggtggcactctgatttcttatgaaggaa

SEQ ID NO: 2791 - DNA, 283 bp, Glycine max
cgacaagcttgtggtgttgaagctaaatggaggcttgggcacaactatgggttgcactggtcctaaatctgtaattgaagttcgtgatgggttgacatttctagatttaattgtgatccagattgagaatctcaattccaaatatggaagcaatgttcctttgcttttgatgaattcattcaacactcatgatgacactcaaaagattgttgaaaaataccaaaactccaatattgagattcatacttttaaccagagccagtatcctcgattggttgctgag

SEQ ID NO: 2792 - DNA, 306 bp, Glycine max
  unsure (1)..(306): unsure at all n locations
aagctaaatggaggcttgggcacaactatgggttgcactggtcctaaatctgtaattgaagttcgtgatgggttgacatttctagatttaattgtgatccagattgagaatctcaattccaaatatggaagcaatgttcctttgcttttgatgaattcattcaacactcatgatgacactcaaaagattgttgaaaaataccaaaactccaatattgagattcatncttttaaccagagccagtatcctcgattggttgctgagggactttttgccattgccttccaaagggcatactgacaagga

SEQ ID NO: 2793 - DNA, 263 bp, Glycine max
gacaaggatggatggtaccctcctggccatggagatgtctttccatcattattgaacagtggcaaacttgatgcactattgtcacagggtaaagagtatgtatttgttgccaattcagataacttgggagctatagttgacttgaaaatcttaaatcatttgatccagaacaagaatgaatactgtatggaggtgactcccaaaacattggctgatgtaaagggtggcactttgatttcttacgaaggaagggttcagctttt

SEQ ID NO: 2794 - DNA, 274 bp, Glycine max
cttttaaccagagccagtatcctcgattggttgctgaggactttttgccattgccttccaaagggcatactgacaaggatggatggtaccctcctggccatggagatgtctttccatcattattgaacagtggcaaacttatgcactattgtcacagggtaaagagtatgtatttgttgccaattcagataacttgggagctatagttgacttgaaaatcttaaatcattgatccagaacaagaatgaatactgtatggaggtgactcccaaaa

SEQ ID NO: 2795 - DNA, 273 bp, Glycine max
acgctgcgagaagacgacagaaggggatttaattgtcatccaaattgagaatcccaattccaaatatggaagcaatgttcctttgcttttgatgaattcattcaacactcatgatgacactcaaaagattgttgaaaaataccaaaactcaaatattgagattcatacttttaaccagagccagtatcctcgattggttgttgaggactctttgccattgccttccaaagggcatactgacaaggatggatggtaccctcctggccatggtga

SEQ ID NO: 2796 - DNA, 254 bp, Glycine max
  unsure (1)..(254): unsure at all n locations
aattgaagttcgtgatgggttgacatttctagatttaattgtgatccagattgagaatctcaattccaaatatggaagcaatgttcctttgcttttgatgaattcattcaacactcatgatgacactcaaaagattgttgaaaaataccaaaactccaatattgagattcatacttttaaccagagccagtatcctcgattggttgctgaggactttttgccattgccttccaaagggcatactgacaagnatg

SEQ ID NO: 2797 - DNA, 274 bp, Glycine max
ccaaaactccaatattgagattcatacttttaaccagagccagtatcctcgattggttgctgaggactttttgccattgccttccaaagggcatactgacaaggatggatggtaccctcctggccatggagatgtctttccacattattgaacagtggcaaacttgatgcactattgtcacagggtaaagagtatgtatttgttgccaattcagataacttgggagctatagttgacttgaaaatcttaaatcatttgatccagaacaagaatg

SEQ ID NO: 2798 - DNA, 243 bp, Glycine max
ccagattgagaatctcaattccaaatatggaagcaatgttcctttgcttctgatgaattcattcaacactcatgatgacactcaaaagattgttgaaaaataccaaaactccaatattgagattcatacttttaaccagagccagtatcctcgattggttgctgaggactttttgccattgccttccaaagggcatactgacaaggatggatggtaccctcctggccatggagatgtctttcc

SEQ ID NO: 2799 - DNA, 253 bp, Glycine max
caagggcatactgacaaggatggatggtaccctcctggccatggtgatgtcttcccatcattattgaacagtggcaaacttgatgcactattgtcacagggtaaagagtatgtgtttgttgccaattcggttaacttgggagctatagttgacttgaaaatcttgaatcatttgatccagaacaagaatgaatactgtatggaggtgactcccaaaacattggctgatgtaaagggtggcactttgatttctt

SEQ ID NO: 2800 - DNA, 246 bp, Glycine max
caaaagattgttgaaaaataccaaaactcaaatattgagattcatacttttaaccagagccagtatcctcgattggttgttgaggactttttgccattgccttccaaagggcatactgacaaggatggatggtaccctcctggccatggtgatgtcttcccatcattattgaacagtggcaaacttgatgcactattgtcacatggtaaagagtatgtgtttgttgccaattcggataacttggga

SEQ ID NO: 2801 - DNA, 265 bp, Glycine max
cgcatgtacgcgtacgcggcattcggctcgagcaagttgtggtgttgaagctaaatggaggcttgggaacaactatgggttgcactggtcctaaatctgtaattgaagttcgtgatgggttgacatttctagatttaattgtcatccaaattgagaatctcaattccaaatatggaagcaatgttcctttgcttttgatgaattcattcaacactcatgatgacactcaaaagattgttgaaaaataccaaaactcaaatattga

SEQ ID NO: 2802 - DNA, 261 bp, Glycine max
atctagaggttgacatttctagatttaattgtgatccagattgagaatctcaattccaaatatggaagcaatgttcctttgcttttgatgaattcattcaacactcatgatgacactcaaaagattgttgaaaaataccaaaactccaatattgagattcatacttttaaccagagccagtatcctcgattggttgctgaggactttttgccattgccttacaaaggggatactgactccgatggctggtaccctcctggc

SEQ ID NO: 2803 - DNA, 195 bp, Glycine max
gatgaattcattcaacactcatgatgacactcaggagattgttgaaaaataccagaactcaaatattgagattcatacttttaaccagagccagtatcctcgattggttgttgaggactttttgccattgccttccaaagggcatactgacaaggatggatggtaccctcctggccatggtgatgtcttcccatc

SEQ ID NO: 2804 - DNA, 265 bp, Glycine max
gttgaagctaaatggaggcttgggcacaactatgggttgcactggtcctaaatctgtaattgaagttcgtgatgggttgacatttctagattgaatggtgatccagattgagaatctcaattccaaatatggaagcaagttcctttgcttttgatgaattcattcaacactcatgatgacactcaaaagattgttgaaaaataccaaaactccaatattgagattcatacttttaaccagagccagtatcctcgattggttgctg

SEQ ID NO: 2805 - DNA, 262 bp, Glycine max
gcaatgtatggtttggagctggtgttatcctcaagggaaaaatcagtatcgtggccaatcctggtgttaagctggaagttcccgatggtgctgtcatttcggataaggaaattaatggcccagaggacctcctgtgaggaagcccgctgagtttagaagtatcagactgtatactatctttatggtctcatgttttttccaattattactactcccaagtttgatgggcaaagaaaataagtccctttttgtttgtcttctg

SEQ ID NO: 2806 - DNA, 249 bp, Glycine max
gctggtgttatcctcaagggaaaaatcagtatcgtggccaatcctggtgttaagctggaagttcccgatggtgctgtcatttcggataaggaaattaatggcccagaggacctcctgtgaggaagcccgctgagtttagaagtatcagactgtatactatctttatggtctcatgttttttccaattattactactcccaagtttgatgggcaaagaaaataagtccctttttgtttgtcttctgattc

SEQ ID NO: 2807 - DNA, 183 bp, Glycine max
cagaatttaagaaggttagcaatttcttgagccggttcaagtcaatccccatattgttgagcttgacagtctaaaagtggcaggcgatgtatggtttggagctggtgtaatccttaagggaaaagcaagtattcttgcaaaaccgggtgtgaagctggaaatacctgacggagctgtgatcgc

SEQ ID NO: 2808 - DNA, 184 bp, Glycine max
  unsure (1)..(184): unsure at all n locations
aggggnnntttgattgatatggaatgctacactcaagcatagctatgacatcccatgctccctaacctaagcatttggctcgagccttcctttaaacctaagccgttagcctgaatgggtggtgaagaccttttggcaatggccttccaaaggccttcctgccaaggttggttggtaccttcct

SEQ ID NO: 2809 - DNA, 389 bp, Glycine max
  unsure (1)..(389): unsure at all n locations
accacgcgtccgtttcaaactcatcgatacaacaaacatgtgggtgagtttaagagccatcaagaggtttgttgacactgttgaagtaaggcagaagaagccctcattttcaaaggacacagcagctggaccagcaataaagttctttgataatgtatttggtgtctccgtgcccgaatctcgctttcttcccttggatgcaacatcagatctattacttcttcagtcagatctatacacttgtagagaaggtgttttaactcgaaatccagctagaactaaccctttaaatcctgtgatagacttgggacctgaatttgaaaagtttggtgactttcanagtcgcttcagatccattccaagcatcattgaggttggacagtttgatg

SEQ ID NO: 2810 - DNA, 411 bp, Glycine max
tcgagcttcttcttctctcgaatcttccaccgcaatgaccaccgccaccgagaagctctccgctctcaaatccgccgtcgccggattgaacgaaatcagtgagagtgagaagaacggattcatcagcctcgtcagccgctatctcagtggcgaagcgcagcatgtggaatggagcaagatccagacgcctacggacgaagtggttgtgccttacgacactttggcgccaactcctgatggttcttcggacgtgaagaatctattggacaagcttgtggtgttgaagctaaatggaggcttgggcacaactatgggttgcactggtcctaaatctgtaattgaagttcgtgatgggttgacatttctagatttaattgtgatccagattgagaatctcaattccaaatatgg

SEQ ID NO: 2811 - DNA, 358 bp, Glycine max
ggcactttgatttcttacgaaggaagggttcagcttttggaaattgcacaagtcccagatgaacatgtcaatgagttcaagtcaatagagaagttcaaaattttcaacacaaataatttgtgggtgaacttaaatgcagttaaaaggcttgttgaagctgatgctcttaagatggaaattattcccaatccaaaggaagttgatggaataaaagttcttcagctggaaactgcagctggtgctgcaataaggttctttgacaaggctattgggattaatgttcctcgatcacgattccttcctgtgaaggcaacttcagatttgcttcttgtccagtctgacctctacactttggaag

SEQ ID NO: 2812 - DNA, 404 bp, Glycine max
gattgttgttatataccaaaactccaatattgagattcatacttttaaccagagccagtatcctcgattggttgctgaggactttttgccattgccttccaaagggcatactgacaaggatggatggtaccctcctggccatggagatgtctttccatcattattgaacagtggcaaacttgatgcactattgtcacagggtaaagagtatgtatttgttgccaattcagataacttgggagctatagttgacttgagtatccttatttaagtttcattggttctttctgtattgtttgtaatgagctttggccacattacttattattacataaaatcagtgtctttctttagtgccatcagtgtacttgactcattgatgtagaaatcttaaatcatttgat

SEQ ID NO: 2813 - DNA, 372 bp, Glycine max
tacggctgcgagaagacgacagaaggggagtaaaagttcgtcaattggaaactgcagctggtgcagcagtaaggttctttgacaaagctattggcattaatgtgcctcgatctcgcttccttcgcgtgaaggcaacttcagacttgcatcttgtccagtcggacctttacactttacaagatggattggttattaggaaccaatctagggcaaatcctgaaaatccttccattgaattggggccagaatttaagaatgttagcaatttcttgagccggttcatgtcaatccccagtaatgttgagcttgacagtctaaaagtggcaggcgatgtatggtttggagctggtgtaatccttagaggaaaagcaa

SEQ ID NO: 2814 - DNA, 415 bp, Glycine max
agtacggctgcgagaagacgacagaaggggagtaaaagttcttcaattggaaactgcagctggtgcagcagtaaggttctttgacaaagctattggcattaatgtgcctcgatctcgcttccttcgcgtgaaggcaacttcagacttgcatcttgtcgagtcggacctttacactttacaagatggattggttattaggaaccaatctagggcaaatcctgaaaatccttccattgaattggggccagaatttaagaatgttagcaatttcttgagccggttcaagtcaatccccagtattgttgagcttgacagtctaaaagtggcaggcgatgtatggtttgaacctggtgtaatccttacaggacaagcaagtattcttgcataaccgggtgtgaagctggaaatacctgac

We claim:

1. A substantially purified nucleic acid molecule that encodes a maize or a soybean enzyme, wherein said nucleic acid molecule comprises a nucleic acid sequence which shares between 100% and 95% sequence identity with a nucleic acid sequence selected from the group consisting of SEQ ID NOs:11, 446, 935, 1108, 2042, 2166, 2252, 2644, 2681, and 2753, wherein said enzyme encoded by said nucleic acid molecule is triose phosphate isomerase, vacuolar $H^+$ translocating-pyrophosphatase, sucrose synthase, hexokinase, fructose 1,6-bisphosphate aldolase, fructose 6-phosphate 2-kinase, invertase, fructokinase, NDP-kinase, and UDP-glucose pyrophosphorylase, respectively.

2. The substantially purified nucleic acid molecule of claim 1, wherein said enzyme is a maize triose phosphate isomerase, and wherein said nucleic acid sequence shares between 100% and 95% sequence identity with the nucleic acid sequence of SEQ ID NO: 11.

3. The substantially purified nucleic acid molecule of claim 1, wherein said enzyme is a maize vacuolar $H^+$ translocating-pyrophosphatase, and wherein said nucleic acid sequence shares between 100% and 95% sequence identity with the nucleic acid sequence of SEQ ID NO: 446.

4. The substantially purified nucleic acid molecule of claim 1, wherein said enzyme is a maize sucrose synthase, and wherein said nucleic acid sequence shares between 100% and 95% sequence identity with the nucleic acid sequence of SEQ ID NO: 935.

5. The substantially purified nucleic acid molecule of claim 1, wherein said enzyme is a maize hexokinase, and wherein said nucleic acid sequence shares between 100% and 95% sequence identity with the nucleic acid sequence of SEQ ID NO: 1108.

6. The substantially purified nucleic acid molecule of claim 1, wherein said enzyme is a soy fructose 1,6-bisphosphate aldolase, and wherein said nucleic acid sequence shares between 100% and 95% sequence identity with the nucleic acid sequence of SEQ ID NO: 2042.

7. The substantially purified nucleic acid molecule of claim 1, wherein said enzyme is a soy fructose 6-phosphate 2-kinase, and wherein said nucleic acid sequence shares between 100% and 95% sequence identity with the nucleic acid sequence of SEQ ID NO: 2166.

8. The substantially purified nucleic acid molecule of claim 1, wherein said enzyme is a soy invertase, and wherein said nucleic acid sequence shares between 100% and 95% sequence identity with the nucleic acid sequence of SEQ ID NO: 2252.

9. The substantially purified nucleic acid molecule of claim 1, wherein said enzyme is a soy fructokinase, and wherein said nucleic acid sequence shares between 100% and 95% sequence identity with the nucleic acid sequence of SEQ ID NO: 2644.

10. The substantially purified nucleic acid molecule of claim 1, wherein said enzyme is a soy NDP-kinase, and wherein said nucleic acid sequence shares between 100% and 95% sequence identity with the nucleic acid sequence of SEQ ID NO: 2681.

11. The substantially purified nucleic acid molecule of claim 1, wherein said enzyme is a soy UDP-glucose pyrophosphorylase, and wherein said nucleic acid sequence shares between 100% and 95% sequence identity with the nucleic acid sequence of SEQ ID NO: 2753.

12. A substantially purified nucleic acid molecule comprising a nucleic acid sequence which shares between 100% and 95% sequence identity with a nucleic acid sequence selected from the group consisting of SEQ ID NOs: 11, 446, 935, 1108, 2042, 2166, 2252, 2644, 2681, and 2753.

13. The substantially purified nucleic acid molecule of claim 12, wherein said nucleic acid molecule comprises a nucleic acid sequence which shares bewteen 100% and 95% sequence identity with a nucleic acid sequence of SEQ ID NO: 11.

14. The substantially purified nucleic acid molecule of claim 12, wherein said nucleic acid molecule comprises a nucleic acid sequence which shares between 100% and 95% sequence identity with the nucleic acid sequence of SEQ ID NO: 446.

15. The substantially purified nucleic acid molecule of claim 12, wherein said nucleic acid molecule comprises a nucleic acid sequence which shares between 100% and 95% sequence identity with the nucleic acid sequence of SEQ ID NO: 935.

16. The substantially purified nucleic acid molecule of claim 12, wherein said nucleic acid molecule comprises a nucleic acid sequence which shares between 100% and 95% sequence identity with the nucleic acid sequence of SEQ ID NO: 1108.

17. The substantially purified nucleic acid molecule of claim 12, wherein said nucleic acid molecule comprises a nucleic acid sequence which shares between 100% and 95% sequence identity with the nucleic acid sequence of SEQ ID NO: 2042.

18. The substantially purified nucleic acid molecule of claim 12, wherein said nucleic acid molecule comprises a nucleic acid sequence which shares between 100% and 95% sequence identity with the nucleic acid sequence of SEQ ID NO: 2166.

19. The substantially purified nucleic acid molecule of claim 12, wherein said nucleic acid molecule comprises a nucleic acid sequence which shares between 100% and 95% sequence identity with the nucleic acid sequence of SEQ ID NO: 2252.

20. The substantially purified nucleic acid molecule of claim 12, wherein said nucleic acid molecule comprises a nucleic acid sequence which shares between 100% and 95% sequence identity with the nucleic acid sequence of SEQ ID NO: 2644.

21. The substantially purified nucleic acid molecule of claim 12, wherein said nucleic acid molecule comprises a nucleic acid sequence which shares between 100% and 95% sequence identity with the nucleic acid sequence of SEQ ID NO: 2681.

22. The substantially purified nucleic acid molecule of claim 12, wherein said nucleic acid molecule comprises a nucleic acid which shares between 100% and 95% sequence identity with the nucleic acid sequence of SEQ ID NO: 2753.

23. A transformed seed comprising a transformed plant cell comprising a nucleic acid molecule which comprises
  (a) an exogenous promoter region which functions in said plant cell to cause the production of an mRNA molecule, which is linked to;
  (b) a structural nucleic acid molecule, wherein said structural nucleic acid molecule comprises a nucleic acid sequence, wherein said nucleic acid sequence shares between 100% and 95% sequence identity with a nucleic acid sequence selected from the group consisting of SEQ ID NOs: 11,446,935, 1108, 2042, 2166, 2252, 2644, 2681, 2753 and complements thereof, which is linked to;
  (c) a 3' non-translated sequence that functions in said plant cell to cause the termination of transcription and the addition of polyadenylated ribonucleotides to said 3' end of said mRNA molecule.

24. The transformed seed according to claim 23, wherein said nucleic acid sequence shares 100% sequence identity with a nucleic acid sequence selected from the group consisting of SEQ ID NOs: 11, 446, 935, 1108, 2042, 2166, 2252, 2644, 2681, 2753 and complements thereof.

25. A method of growing a transgenic plant comprising
(a) planting a transformed seed comprising a nucleic acid molecule, which comprises a nucleic acid sequence, wherein said nucleic acid sequence shares between 100% and 95% sequence identity with a nucleic acid sequence selected from the group consisting of SEQ ID NOs: 11, 446, 935, 1108, 2042, 2166, 2252, 2644, 2681, 2753, and complements thereof; and
(b) growing a plant from said seed.

* * * * *

UNITED STATES PATENT AND TRADEMARK OFFICE
CERTIFICATE OF CORRECTION

PATENT NO. : 7,598,361 B2  
APPLICATION NO. : 09/237183  
DATED : October 6, 2009  
INVENTOR(S) : Cheikh et al.

Page 1 of 1

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 402 days.

Signed and Sealed this

Twenty-eighth Day of September, 2010

David J. Kappos  
*Director of the United States Patent and Trademark Office*